United States Patent
Shen et al.

(10) Patent No.: US 11,512,311 B2
(45) Date of Patent: Nov. 29, 2022

(54) SYSTEMS AND METHODS FOR TREATING ALPHA 1-ANTITRYPSIN (A1AT) DEFICIENCY

(71) Applicant: EDITAS MEDICINE, INC., Cambridge, MA (US)

(72) Inventors: Shen Shen, Watertown, MA (US); Penrose O'Donnell, Yarmouth, ME (US); Minerva Sanchez, Brookline, MA (US)

(73) Assignee: EDITAS MEDICINE, INC., Cambridge, MA (US)

( * ) Notice: Subject to any disclaimer, the term of this patent is extended or adjusted under 35 U.S.C. 154(b) by 154 days.

(21) Appl. No.: 16/088,430

(22) PCT Filed: Mar. 24, 2017

(86) PCT No.: PCT/US2017/024163
§ 371 (c)(1),
(2) Date: Sep. 25, 2018

(87) PCT Pub. No.: WO2017/165862
PCT Pub. Date: Sep. 28, 2017

(65) Prior Publication Data
US 2020/0216843 A1   Jul. 9, 2020

Related U.S. Application Data

(60) Provisional application No. 62/452,333, filed on Jan. 30, 2017, provisional application No. 62/313,688, filed on Mar. 25, 2016.

(51) Int. Cl.
*C07H 21/04* (2006.01)
*C12N 15/113* (2010.01)
*C12N 9/22* (2006.01)
*C12N 15/86* (2006.01)

(52) U.S. Cl.
CPC ............. *C12N 15/113* (2013.01); *C12N 9/22* (2013.01); *C12N 15/86* (2013.01); *C12N 2310/20* (2017.05)

(58) Field of Classification Search
None
See application file for complete search history.

(56) References Cited

U.S. PATENT DOCUMENTS

| | | |
|---|---|---|
| 6,413,540 B1 | 7/2002 | Yaacobi |
| 6,586,240 B1 | 7/2003 | Singer et al. |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,889,394 B2 | 11/2014 | Chalasani et al. |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 9,322,037 B2 | 4/2016 | Liu et al. |
| 9,499,847 B2 | 11/2016 | Porter et al. |
| 2003/0186238 A1 | 10/2003 | Allawi et al. |
| 2007/0020627 A1 | 1/2007 | Barbas |
| 2010/0055793 A1 | 3/2010 | Chandrasegaran et al. |
| 2010/0055798 A1 | 3/2010 | Battersby |
| 2010/0076057 A1 | 3/2010 | Sontheimer et al. |
| 2011/0059502 A1 | 3/2011 | Chalasani |
| 2011/0189776 A1 | 8/2011 | Terns et al. |
| 2011/0223638 A1 | 9/2011 | Wiedenheft et al. |
| 2011/0236894 A1 | 9/2011 | Rao et al. |
| 2011/0301073 A1 | 12/2011 | Gregory et al. |
| 2012/0270273 A1 | 10/2012 | Zhang et al. |
| 2013/0130248 A1 | 5/2013 | Haurwitz et al. |
| 2013/0253040 A1 | 9/2013 | Miller et al. |
| 2014/0068797 A1 | 3/2014 | Doudna et al. |
| 2014/0179770 A1 | 6/2014 | Zhang et al. |
| 2014/0242699 A1 | 8/2014 | Zhang |
| 2014/0309177 A1 | 10/2014 | Perez-Pinera et al. |
| 2014/0315985 A1 | 10/2014 | May et al. |
| 2014/0335620 A1 | 11/2014 | Zhang et al. |
| 2014/0342456 A1 | 11/2014 | Mali et al. |
| 2014/0342457 A1 | 11/2014 | Mali et al. |
| 2014/0342458 A1 | 11/2014 | Mali et al. |

(Continued)

FOREIGN PATENT DOCUMENTS

| | | | |
|---|---|---|---|
| WO | 2002/089767 A1 | 11/2002 | |
| WO | 2003/072788 A1 | 9/2003 | |

(Continued)

OTHER PUBLICATIONS

Cox, Andrew, et al. "333. Simultaneous Disruption of Five SerpinA1 Genes in Mice Using CRISPR/Cas9 to Generate the First Animal Model of Alpha-1 Antitrypsin Deficiency." Molecular Therapy 23 (2015): S133.*
Maslakova et al. (Moscow University Biological Sciences Bulletin, 2015, vol. 70, No. 3, pp. 127-131).*
Sakuma et al. ("Multiplex genome engineering in human cells using all-in-one CRISPR/Cas9 vector system." Scientific reports 4.1 (2014): 1-6).*
Ding, Q., et al., "Enhanced Efficiency of Human Pluripotent Stem Cell Genme Editing through Replacing TALENs with CRIPSRs," Cell Stem Cell 12:393-394 (2013).
Heintze, J., et al., "A CRISPR CASe for High-Throughput Silencing," Front. Genet. 4(193):1-6 (2013).
Mukherjee-Clavin, B., et al., "Current Approaches for Efficient Genetic Editing in Human Pluripotent Stem Cells," Front. Biol. 8(5):461-467 (2013).

(Continued)

*Primary Examiner* — Kimberly Chong
(74) *Attorney, Agent, or Firm* — Perkins Coie LLP; Courtney Prochnow

(57) ABSTRACT

CRISPR/RNA-guided nuclease-related compositions and methods for treatment of A1AT deficiency and associated conditions are disclosed.

14 Claims, 185 Drawing Sheets

Specification includes a Sequence Listing.

(56) References Cited

U.S. PATENT DOCUMENTS

| | | |
|---|---|---|
| 2014/0356958 A1 | 12/2014 | Mali et al. |
| 2015/0232833 A1 | 8/2015 | Mali et al. |
| 2015/0259704 A1 | 9/2015 | Church et al. |
| 2016/0153005 A1* | 6/2016 | Zhang .................... C12N 7/00 800/21 |
| 2016/0281111 A1 | 11/2016 | Cong et al. |
| 2016/0324987 A1 | 11/2016 | Wang et al. |
| 2016/0340661 A1 | 11/2016 | Cong et al. |
| 2017/0058298 A1 | 3/2017 | Kennedy et al. |
| 2018/0291370 A1 | 10/2018 | Gersbach et al. |

FOREIGN PATENT DOCUMENTS

| | | |
|---|---|---|
| WO | 2008/108989 A2 | 9/2008 |
| WO | 2010/054108 A9 | 5/2010 |
| WO | 2011/143124 A2 | 11/2011 |
| WO | 2011/146121 A1 | 11/2011 |
| WO | 2012/145601 A2 | 10/2012 |
| WO | 2012/164565 A8 | 12/2012 |
| WO | 2013/012674 A1 | 1/2013 |
| WO | 2013/066438 A2 | 5/2013 |
| WO | 2013/082519 A2 | 6/2013 |
| WO | 2013/098244 A1 | 7/2013 |
| WO | 2013/141680 A1 | 9/2013 |
| WO | 2013/142578 A1 | 9/2013 |
| WO | 2013/163628 A2 | 10/2013 |
| WO | 2013/176772 A1 | 11/2013 |
| WO | 2013/181228 A1 | 12/2013 |
| WO | 2014/018423 A8 | 1/2014 |
| WO | 2014/022702 A2 | 2/2014 |
| WO | 2014/036219 A2 | 3/2014 |
| WO | 2014/059255 A1 | 4/2014 |
| WO | 2014/065596 A1 | 5/2014 |
| WO | 2014/089290 A1 | 6/2014 |
| WO | 2014/093479 A1 | 6/2014 |
| WO | 2014/093595 A1 | 6/2014 |
| WO | 2014/093622 A8 | 6/2014 |
| WO | 2014/093635 A9 | 6/2014 |
| WO | 2014/093655 A2 | 6/2014 |
| WO | 2014/093661 A2 | 6/2014 |
| WO | 2014/093694 A1 | 6/2014 |
| WO | 2014/093709 A1 | 6/2014 |
| WO | 2014/093712 A1 | 6/2014 |
| WO | 2014/093718 A1 | 6/2014 |
| WO | 2014/099744 A1 | 6/2014 |
| WO | 2014/099750 A2 | 6/2014 |
| WO | 2014/124284 A1 | 8/2014 |
| WO | 2014/144288 A1 | 9/2014 |
| WO | 2014/144592 A2 | 9/2014 |
| WO | 2014/144761 A2 | 9/2014 |
| WO | 2014/152432 A2 | 9/2014 |
| WO | 2014/186585 A2 | 11/2014 |
| WO | 2014/197568 A2 | 12/2014 |
| WO | 2014/197748 A2 | 12/2014 |
| WO | 2014/204578 A1 | 12/2014 |
| WO | 2014/204725 A8 | 12/2014 |
| WO | 2014/204726 A1 | 12/2014 |
| WO | 2015/006290 A1 | 1/2015 |
| WO | 2015/006294 A2 | 1/2015 |
| WO | 2015/006498 A2 | 1/2015 |
| WO | 2015/013583 A8 | 1/2015 |
| WO | 2015/021353 A1 | 2/2015 |
| WO | 2015/027134 A1 | 2/2015 |
| WO | 2015/035136 A8 | 3/2015 |
| WO | 2015/035139 A2 | 3/2015 |
| WO | 2015/035162 A2 | 3/2015 |
| WO | 2015/048577 A2 | 4/2015 |
| WO | 2015/048680 A1 | 4/2015 |
| WO | 2015/070083 A1 | 5/2015 |
| WO | 2015/071474 A9 | 5/2015 |
| WO | 2015/077290 A2 | 5/2015 |
| WO | 2015/077318 A1 | 5/2015 |
| WO | 2015/089406 A1 | 6/2015 |
| WO | 2015/089462 A1 | 6/2015 |
| WO | 2015/099850 A1 | 7/2015 |
| WO | 2015/138510 A8 | 9/2015 |
| WO | 2015/188056 A1 | 12/2015 |
| WO | 2015/195621 A1 | 12/2015 |
| WO | 2016/022363 A9 | 2/2016 |
| WO | 2016/073990 A2 | 5/2016 |
| WO | 2016/094872 A1 | 6/2016 |
| WO | 2016/182959 A1 | 11/2016 |
| WO | 2016/186772 A2 | 11/2016 |
| WO | 2016/205613 A1 | 12/2016 |
| WO | 2016/205749 A1 | 12/2016 |
| WO | 2017/035416 A2 | 3/2017 |
| WO | 2018/126176 A1 | 7/2018 |

OTHER PUBLICATIONS

Cramer, M. L., et al., "Induction of T-Cell Infiltration and Programmed Death Ligand 2 Expression by Adeno-Associated Virus in Rhesus Macaque Skeletal Muscle and Modulation by Prednisone," Hum. Gene Ther. 28(6):493-509 (2017).

Kumar, S. R.P., et al., "Clinical development of gene therapy: results and lessons from recent successes," Mol. Ther. Methods Clin. Dev. 3:16034 (2016).

Sobrevals, L., et al., "AAV Vectors Transduce Hepatocytes In Vivo as Efficiently in Cirrhotic as in Healthy Rat Livers," Gene Ther. 19:411-417 (2012).

Zetsche, B., et al., "Multiplex Gene Editing by CRISPR-Cpf1 Through Autonomous Processing of a Single crRNA Array," Nat. Biotechnol. 35(1):31-34 (2017).

Guo, Q., et al., "'Cold shock' increases the frequency of homology directed repair gene editing in induced pluripotent stem cells," Sci. Rep. 8(1):2080 (2018).

Paix, A., et al., "Precision Genome Editing Using CRISPR-Cas9 and Linear Repair Templates in C. Elegans," Methods 121-121:86-93 (2017).

U.S. Appl. No. 61/652,086, filed May 25, 2012, Jinek et al.
U.S. Appl. No. 61/716,256, filed Oct. 19, 2012, Jinek et al.
U.S. Appl. No. 61/734,256, filed Dec. 6, 2012, Chen et al.
U.S. Appl. No. 61/736,527, filed Dec. 12, 2012, Zhang et al.
U.S. Appl. No. 61/738,355, filed Dec. 17, 2012, Church et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/779,169, filed Mar. 13, 2013, Mali et al.

Al-Attar, S., et al., "Clustered Regularly Interspaced Short Palindromic Repeats (CRISPRs): The Hallmark of an Ingenious Antiviral Defense Mechanism in Prokaryotes," Biol. Chem. 392:277-289 (2011).

Alam, S., et al., "Z Alpha1-Antitrypsin Confers a Proinflammatory Phenotype that Contributes to Chronic Obstructive Pulmonary Disease," Am. J. Respir. Crit. Care Med. 189(8):909-931 (2014).

Altschul, S. F., et al., "Gapped BLAST and PSI-BLAST: A New Generation of Protein Database Search Programs," Nucleic Acids Res. 25(17):3389-3402 (1997).

Altschul, S. F., et al., "Basic Local Alignment Search Tool," J. Mol. Biol. 215(3):403-410 (1990).

Amrani, N., et al., "NmeCas9 is an Intrinsically High-Fidelity Genome-Editing Platform," Genome Biol. 19:214 (2018).

An, J. K., et al., "Quantitative Isolation of AlphaIAT Mutant Z Protein Polymers from Human and Mouse Livers and the Effect of Heat," Hepatology 41(1):160-167 (2005).

Anders, C., et al., "Structural Basis of PAM-Dependent Target DNA Recognition by the Cas9 Endonuclease," Nature 513(7519):569-573 (2014).

Andreas, S., et al., "Enhanced Efficiency Through Nuclear Localization Signal Fusion on Phage PhiC31-Integrase: Activity Comparison with Cre and FLPe Recombinase in Mammalian Cells," Nucleic Acids Res. 30(11):2299-2306 (2002).

Anonymous, Third Party Observation for EP13818570.7, Oct. 1, 2014, 15 pages.

Anonymous, Third Party Observation for EP13824232.6, Sep. 8, 2014, 48 pages.

Anonymous, Third Party Observation for EP13824232.6, Sep. 22, 2014, 19 pages.

(56) References Cited

OTHER PUBLICATIONS

Anonymous, Third Party Observation for EP13824232.6, Oct. 22, 2014, 7 pages.
Bae, S., et al., "Cas-OFFinder: A Fast and Versatile Algorithm that Searches for Potential Off-Target Sites of Cas9 RNA-Guided Endonucleases," Bioinformatics 30(10):1473-1475 (2014).
Baker, M., "Gene Editing at CRISPR Speed," Nat. Biotechnol. 32(4):309-312 (2014).
Barker, C. S., et al., "Increased DNA Microarray Hybridization Specificity Using sscDNA Targets," BMC Genomics 6:57 (2005).
Baron-Benhamou, J., et al., "Using the LambdaN Peptide to Tether Proteins to RNAs," Methods Mol. Biol. 257:135-153 (2004).
Barrangou, R., "RNA-Mediated Programmable DNA Cleavage," Nat. Biotechnol. 30(9):836-838 (2012).
Barretina, J., et al., "The Cancer Cell Line Encyclopedia Enables Predictive Modeling of Anticancer Drug Sensitivity," Nature 483(7391):603-607 (2012).
Bassett, A. R., et al., "CRISPR/Cas9 and Genome Editing in *Drosophila*," J. Genet. Genom. 41:7-19 (2014).
Beerli, R. R., et al., "Toward Controlling Gene Expresion at Will: Specific Regulation of the erbB-2/HER-2 Promoter by Using Polydactyl Zinc Finger Proteins Constructed from Modular Building Blocks," Proc. Natl. Acad. Sci. 95:14628-14633 (1998).
Bhaya, D., et al., "CRISPR-Cas Systems in Bacteria and Archaea: Versatile Small RNAs for Adaptive Defense and Regulation," Annu. Rev. Genet. 45:273-297 (2011).
Bikard, D., et al., "Programmable Repression and Activation of Bacterial Gene Expression Using an Engineered CRISPR-Cas System," Nucl. Acids Res. 41(15)7429-7437 (2013).
Bitinaite, J., et al., "FokI Dimerization is Required for DNA Cleavage," Proc. Natl. Acad. Sci. 95:10570-10575 (1998).
Boch, J., et al., "Breaking the Code of DNA Binding Specificity of TAL-Type III Effectors," Science 326(5959):1509-1512 (2009).
Boch, J., et al., "Xanthomonas AvrBs3 Family-Type III Effectors: Discovery and Function," Annu. Rev. Phytopathol. 48:419-436 (2010).
Bothmer, A., et al., "Characterization of the Interplay Between DNA Repair and CRISPR/Cas9-Induced DNA Lesions at an Endogenous Locus," Nat. Commun. 8:13905 (2017).
Briner, A.E., et al., "Guide RNA Functional Modules Direct Cas9 Activity and Orthogonality," Mol. Cell 56(2):333-339 (2014).
Broad Institute, Communication Forwarding Declaration of Feng Zhang for U.S. Appl. No. 14/256,912, dated Nov. 24, 2014, 5 pages.
Broad Institute, Information Disclosure Statement submitted for U.S. Appl. No. 14/256,912, citing Electronic Mail from T. Kowalski which references Briner et al., Nov. 3, 2014, 8 pages.
Broad Institute, Request for Oral Examination for EP13818570.7, Oct. 27, 2014, 3 pages.
Broad Institute, Response to EP Examination Report for EP13824232. 6, dated Dec. 31, 2014, 44 pages.
Broad Institute, Response to Third Party Observations and Request for Oral Hearing for EP13824232.6, Oct. 27, 2014, 9 pages.
Broad Institute, Response to Third Party Observations, with redlined and clean amended claims, for EP13818570.7, Oct. 16, 2014, 30 pages.
Broad Institute, Response to Third Party Observations, with redlined and clean amended claims, for EP13824232.6, Oct. 2, 2014, 16 pages.
Brummelkamp, T. R., et al., "A System for Stable Expression of Short Interfering RNAs in Mammalian Cells," Science 296(5567):550-553 (2002).
Burstein, D., et al., "New CRISPR-Cas Systems from Uncultivated Microbes," Nature 542(7640):237-241 (2017).
Caldecott, K.W., "Single-Strand Break Repair and Genetic Disease," Nat. Rev. Genet. 9(8):619-631 (2008).
Canver, M. C., "Evaluation of the Clinical Success of Ex Vivo and In Vivo Gene Therapy," Journal of Young Investitgators, http://www.hyi.org/issue/evaluation-of-the-clinical-success-of-ex-vivo-and-in-vivo-gene-therapy/, 9 pages (2009).
Carlson, J. A., et al., "Accumulation of PiZ Alpha 1-Antitrypsin Causes Liver Damage in Transgenic Mice," J. Clin. Invest. 83(4):1183-1190 (1989).
Carroll, D., "A CRISPR Approach to Gene Targeting," Mol. Ther. 20(9):1658-1660 (2012).
Cassini, A., et al., "A Highly Specific SpCas9 Variant is Identified by In Vivo Screening in Yeast," Nat. Biotechnol. 36(3):265-271 (2018).
Cathomen, T., et al., "Zinc-Finger Nucleases: The Next Generation Emerges," Mol. Ther. 16:1200-1207 (2008).
Cermak, T., et al., "Efficient Design and Assembly of Custom TALEN and Other TAL Effector-Based Constructs for DNA Targeting," Nucl. Acids Res. 39(12):e82 (2011).
Chen, X., et al., "Fusion Protein Linkers: Property, Design and Functionality," Adv. Drug Deliv. Rev. 65(10):1357-1369 (2013).
Chen, F., et al., "Targeted Activation of Diverse CRISPR-Cas Systems for Mammalian Genome Editing via Proximal CRISPR Targeting," Nat. Commun. 8:14958 (2017).
Chen, J. S., et al., "Enhanced Proofreading Governs CRISPR-Cas9 Targeting Accuracy," Nature 550(7676):407-410 (2017).
Cho, S. W., et al., Supplementary Information: Targeted Genome Engineering in Human Cells With the Cas9 RNA-Guided Endonuclease, Nature Biotechnology (Mar. 2013) vol. 31, No. 3, 11 pages.
Cho, S. W., et al., "Targeted Genome Engineering in Human Cells with the Cas9 RNA-Guided Endonuclease," Nat. Biotechnol. 31(3):230-232 (2013).
Christian, M., et al., "Targeting DNA Double-Strand Breaks With TAL Effector Nucleases," Genetics 186:757-761 (2010).
Christian, M., et al., "Targeting DNA Double-Strand Breaks With TAL Effector Nucleases," Genetics Supporting Information, 1SI-8SI (2010).
Chylinski, K., et al., "The TrackRNA and Cas9 Families of Type II CRISPR-Cas Immunity Systems," RNA Biol. 10(5)726-737 (2013).
Cong, L., et al., "Multiplex Genome Engineering Using CRISPR/Cas Systems," Science 339(6121):819-823 (2013).
Cong, L. et al., "Supplementary Material: Multiplex Genome Engineering Using CRISPR-Cas Systems," Science Express (Jul. 5, 2012).
Cong, L. et al., "Supplementary Material: Multiplex Genome Engineering Using CRISPR-Cas Systems," Science Express (Jan. 3, 2013).
Cornish-Bowden, A., "Nomenclature for Incompletely Specified Bases in Nucleic Acid Sequences: Recommendations 1984," Nucleic Acids Res. 13(9):3021-3030 (1985).
Cradick, T. J., et al., "CRISPR/Cas9 Systems Targeting Beta-Globin and CCR5 Genes Have Substantial Off-Target Activity," Nucleic Acids Res. 41(20):9584-9592 (2013).
Datsenko, K. A., et al., "Molecular Memory of Prior Infections Activates the CRISPR/Cas Adaptive Bacterial Immunity System," Nat. Commun. 3:945 (2012).
Davis, L., et al., "Homology-Directed Repair of DNA Nicks via Pathways Distinct from Canonical Double-Strand Break Repair," PNAS 111(10):E924-932 (2014).
Deltcheva, E., et al., CRISPR RNA Maturation by Trans-Encoded Small RNA and Host Factor RNase III, Nature 471:602-607 (2011).
Deltcheva, E., et al., Supplementary Figures: CRISPR RNA Maturation by Trans-Encoded Small RNA and Host Factor RNase III. Downloaded from www.nature.com/nature, p. 1-35, 2011.
Deveau, H., et al., "Phage Response to CRISPR-Encoded Resistance in *Streptococcus thermophilus*," J. Bacteriol. 190(4): 1390-1400 (2008).
Dever, D. P., et al., "CRISPR/Cas9 Beta-Globin Gene Targeting in Human Haematopoietic Stem Cells," Nature 539:384-389 (2016).
Dicarlo, J. E., et al., "Genome Engineering in *Saccharomyces cerevisiae* Using CRISPR-Cas Systems," Nucl. Acids Res. 41(7):4336-43 (2013).
Dingwall, C., et al., "A Polypeptide Domain That Specifies Migration of Nucleoplasmin Into the Nucleus," Cell 30:449-458 (1982).
Dreszer, T. R., et al., "The UCSC Genome Browser Database: Extensions and Updates 2011," Nucl. Acids Res. 40:D918-D923 (2012).
Esvelt, K.M., et al., "A System for the Continuous Directed Evolution of Biomolecules," Nature 472(7344):499-503 (2011).

(56) References Cited

OTHER PUBLICATIONS

Esvelt, K. M., et al., "Orthogonal Cas9 Proteins for RNA-Guided Gene Regulation and Editing," Nat. Methods 10(11):1116-1121 (2013).
Fine, E.J., et al., "Trans-Spliced Cas9 Allows Cleavage of HBB and CCR5 Genes in Human Cells Using Compact Expression Cassettes," Sci. Rep. 5:10777 (2015).
Fonfara, I., et al., "Phylogeny of Cas9 Determines Functional Exchangeability of Dual-RNA and Cas9 Among Orthologous Type II CRISPR-Cas Systems," Nucl. Acids Res.42(4):2577-2590 (2014).
Friedland, A.E., et al., "Characterization of *Staphylococcus aureus* Cas9: A Smaller Cas9 for All-in-One Adeno-Associated Virus Delivery and Paired Nickase Applications," Genome Biol. 16:257 (2015).
Frit, P., et al., "Alternative End-Joining Pathway(s): Bricolage at DNA Breaks," DNA Repair (Amst) 17:81-97 (2014).
Fu, Y., et al., "High-Frequency Off-Target Mutagenesis Induced by CRISPR-Cas Nucleases in Human Cells," Nat. Biotechnol. 31:822-826 (2013).
Fu, Y., et al., "Targeted Genome Editing in Human Cells Using CRISPR/Cas Nucleases and Truncated Guide RNAs," Methods Enzymol. 546:21-45 (2014).
Fu, Y., et al., "Improving CRISPR-Cas Nuclease Specificity Using Truncated Guide RNAs," Nat. Biotechnol. 32(3):279-284 (2014).
Gabriel, R., et al., "An Unbiased Genome-Wide Analysis of Zinc-Finger Nuclease Specificity," Nat. Biotechnol. 29:816-823 (2011).
Garneau, J. E., et al., "The CRISPR-Cas Bacterial Immune System Cleaves Bacteriophage and Plasmid DNA," Nature 468:67-71 (2010).
Gasiunas, G., et al., "Cas9-crRNA Ribonucleoprotein Complex Mediates Specific DNA Cleavage for Adaptive Immunity in Bacteria," Proc. Natl. Acad. Sci. 109(39):E2579-E2586 (2012).
Gilbert, L. A., et al., "CRISPR-Mediated Modular RNA-Guided Regulation of Transcription in Eukaryotes," Cell 154(2):442-451 (2013).
Goldfarb, D. S., et al., "Synthetic Peptides as Nuclear Localization Signals," Nature 322:641-644 (1986).
Gratz, S. J., et al., "Genome Engineering of *Drosophila* with the CRISPR RNA-Guided Cas9 Nuclease," Genetics 194(4):1029-1035 (2013).
Greene, C. M., et al., "Z Alpha-1 Antitrypsin Deficiency and the Endoplasmic Reticulum Stress Response," World J. Gastrointest. Pharmacol. Ther. 1(5):94-101 (2010).
Grieger, J. C., et al., "Production and Characterization of Adeno-Associated Viral Vectors," Nat. Protoc. 1(3):1412-1428 (2006).
Guilinger, J. P., et al., "Fusion of Catalytically Inactive Cas9 to FokI Nuclease Improves the Specificity of Genome Modification," Nat Biotechnol. 32(6):577-583 (2014).
Guo, X., et al., "RNA-Dependent Folding and Stabilization of C5 Protein During Assembly of the *E. coli* Rnase P Holoenzyme," J. Mol. Biol. 360:190-203 (2006).
Gustafsson, C., et al., "Codon Bias and Heterologous Protein Expression," Trends Biotechnol. 22(7):346-353 (2004).
Haft, D. H., et al., "A Guild of 45 CRISPR-Associated (Cas) Protein Families and Multiple CRISPR/Cas Subtypes Exist in Prokaryotic Genomes," PLoS Comput. Biol. 1(6):e60 (2005).
Hale, C. R., et al., "Essential Features and Rational Design of CRISPR RNAs That Function With the Cas RAMP Module Complex to Cleave RNAs," Mol. Cell 45(3):292-302 (2012).
Hatoum-Aslan, A., et al. "Mature Clustered Regularly Interspaced, Short Palindromic Repeats RNA 5,9,14 (crRNA) Length is Measured by a Ruler Mechanism Anchored at the Precursor Processing Site," Proc. Natl. Acad. Sci. 108(52):21218-21222 (2011).
Heigwer, F., et al., "E-CRISP: Fast CRISPR Target Site Identification," Nat. Methods 11(2):122-123 (2014).
Hinz, J. M., et al., "Nucleosomes Selectively Inhibit Cas9 Off-Target Activity at a Site Located at the Nucleosome Edge," J. Biol. Chem. 291(48):24851-24856 (2016).
Hockemeyer, D., et al., "Efficient Targeting of Expressed and Silent Genes in Human ESCs and iPSCs Using Zinc-Finger Nucleases," Nat. Biotechnol. 27(9):851-857 (2009).
Hockemeyer, D., et al., "Genetic Engineering of Human Iuripotent Cells Using TALE Nucleases," Nat. Biotechnol. 29:731-734 (2011).
Holt, N, et al., "Zinc Finger Nuclease-Mediated CCR5 Konockout Hematopoietic Stem Cell Transplantation Controls HIV-1 In Vivo," Nat. Biotechnol. 28(8):839-847 (2010).
Horvath, P., et al., "CRISPR/Cas, The Immune System of Bacteria and Archaea," Science 327(5962):167-170 (2010).
Horvath, P., et al., "RNA-Guided Genome Editing A La Carte," Cell Res. 23:733-734 (2013).
Hou, Z., et al., "Efficient Genome Engineering in Human Pluripotent Stem Cells Using Cas9 from Neisseria Meningitidis," Proc. Natl. Acad. Sci. U.S.A. 110(39):15644-15649 (2013).
Hsu, P.D., et al., "DNA Targeting Specificity of RNA-Guided Cas9 Nucleases," Nat. Biotechnol. 31(9):827-832 (2013).
Hwang, W. Y., et al., "Heritable and Precise Zebrafish Genome Editing Using a CRISPR-Cas System," PLoS One 8(7):e68708 (2013).
Hwang, W. Y., et al., "Efficient Genome Editing in Zebrafish Using a CRISPR-Cas System," Nat. Biotechnol. 31(3):227-229 (2013).
Iyama, T., et al., "DNA Repair Mechanisms in Dividing and Non-Dividing Cells," DNA Repair (Amst.) 12(8):620-636 (2013).
Iyer, L. M., et al., "Prediction of Novel Families of Enzymes Involved in Oxidative and Other Complex Modifications of Bases in Nucleic Acids," Cell Cycle 8(11):1698-1710 (2009).
Jiang, W., et al., "RNA-Guided Editing of Bacterial Genomes Using CRISPR-Cas Systems," Nat. Biotechnol. 31(3):233-239 (2013).
Jinek, M., et al., "A Programmable Dual-RNA-Guided DNA Endonuclease in Adaptive Bacterial Immunity," Science 337(6096):816-821 (2012).
Jinek, M., et al., "Structures of Cas9 Endonucleases Reveal RNA-Mediated Conformational Activation," Science 343(6176):1247997 (2014).
Jinek, M., et al., "RNA-Programmed Genome Editing in Human Cells," eLife 2:e00471 (2013).
Joung, J., et al., "Genome-Scale CRISPR-Cas9 Knockout and Transcriptional Activation Screening," Nat. Protoc. 12(4):828-863 (2017).
Kaiser, J., "The Gene Editor CRISPR Won't Fully Fix Sick People Anytime Soon. Here's Why," (May 3, 2016), Biol., Technol, CRISPR, DOI: 10.1126/science.aaf5689, 5 pages.
Karolchik, D., et al., "The UCSC Table Browser Data Retrieval Tool," Nucleic Acids Research 32:D493-496 (2004).
Karvelis, T., et al., "crRNA and tracrRNA Guide Cas9-Mediated DNA Interference in *Streptococcus thermophilus*," RNA Biol. 10(5):841-851 (2013).
Kent, W. J., et al., "The Human Genome Browser at UCSC," Genome Research 12:996-1006 (2002).
Keryer-Bibens, C., et al., "Tethering of Proteins to RNAs by Bacteriophage Proteins," Biol. Cell, 100:125-138 (2008).
Khalil, A. S., et al., "Synthetic Biology: Applications Come of Age," Nat. Rev. Genet. 11(5):367-379 (2010).
Kim, H.S., et al., "Problems Encountered in Detecting a Targeted Gene by the Polymerase Chain Reaction," Gene 103:227-233 (1991).
Kim, Y.G., et al., "Hybrid Restriction Enzymes: Zinc Finger Fusions to Fok I Cleavage Domain," Proc. Natl. Acad. Sci. USA 93:1156-1160 (1996).
Kim, E., et al., "In Vivo Genome Editing with a Small Cas9 Orthologue Derived from Campylobacter Jejuni," Nat. Commun. 8:14500 (2017).
King, N. M.P., et al., "En Route to Ethical Recommendations for Gene Transfer Clinical Trials," Mol. Ther. 16(3):432-438 (2008).
Kleinstiver, B.P., et al., "Broadening the Targeting Range of *Staphylococcus aureus* CRISPR-Cas9 by Modifying PAM Recognition," Nat. Biotechnol. 33(12):1293-1298 (2015).
Kleinstiver, B.P., et al., "Engineered CRISPR-Cas9 Nucleases with Altered PAM Specificities," Nature 523(7561):481-485 (2015).
Kleinstiver, B.P., et al., "High-Fidelity CRISPR-Cas9 Nucleases with No Detectable Genome-Wide Off-Target Effects," Nature 529(7587):490-495 (2016).
Koike-Yusa, H., et al., "Genome-Wide Recessive Genetic Screening in Mammalian Cells with a Lentiviral CRISPR-Guide RNA Library," Nat. Biotechnol. 32(3):267-273 (2014).

(56) References Cited

OTHER PUBLICATIONS

Kok, K. F., et al., "Prevalence of Genetic Polymorphisms in the Promoter Region of the Alpha-1 Antitrypsin (SERPINA1) Gene in Chronic Liver Disease: A Case Control Study," BMC Gastroenterol. 10:22 (2010).

Komor, A.C., et al., "Programmable Editing of a Target Base in Genomic DNA Without Double-Stranded DNA Cleavage," Nature 533(7603):420-424 (2016).

Kosuri, S., et al., "A Scalable Gene Synthesis Platform Using High-Fidelity DNA Microchips," Nat. Biotechnol. 28(12):1295-1299 (2010).

Lambowitz, A. M., et al., "Group II Introns: Mobile Ribozymes that Invade DNA," Cold Spring Harb. Perspect. Biol. 3:a003616 (2011).

Langmead, B., et al., "Ultrafast and Memory-Efficient Alignment of Short DNA Sequences to the Human Genome," Genome Biology 10(3):R25 (2009).

Lee, J.H., et al., "A Robust Approach to Identifying Tissue-Specific Gene Expression Regulatory Variants Using Personalized Human Induced Pluripotent Stem Cells," PLoS Genetics 5(11):e1000718 (2009).

Lee, J., et al., "Non-Endocytic Delivery of Functional Engineered Nanoparticles into the Cytoplasm of Live Cells Using a Novel, High-Throughput Microfluidic Device," Nano Lett. 12(12):6322-6327 (2012).

Lee, J. K., et al., "Directed evolution of CRISPR-Cas9 to Increase Its Specificity," Nat. Commun. 9:3048 (2018).

Li, G.M., "Mechanisms and Functions of DNA Mismatch Repair," Cell Res. 18(1):85-98 (2008).

Li, T., et al., "TAL Nucleases (TALNs): Hybrid Proteins Composed of TAL Effectors and FokI DNA-Cleavage Domain," Nucl. Acids Res.39(1): 359-372 (2011).

Li, H., et al., "In Vivo Genome Editing Restores Hemostasis in a Mouse Model of Hemophilia," Nature 475(7355):217-221 (2011).

Li, T., et al., "Modularly Assembled Designer TAL Effector Nucleases for Targeted Gene Knockout and Gene Replacement in Eukaryotes," Nucl. Acids Res. 39(14):6315-6325 (2011).

Liang, P., et al., "CRISPR/Cas9-Mediated Gene Editing in Human Tripronuclear Zygotes," Protein Cell 6(5):363-372 (2015).

Lindblad, D., et al., "Alpha-1-Antitrypsin Mutant Z Protein Content in Individual Hepatocytes Correlates with Cell Death in a Mouse Model," Hepatology 46(4):1228-1235 (2007).

Lombardo, A., et al., "Gene Editing in Human Stem Cells Using Xinc Finger Nucleases and Integrase-Defective Lentiviral Vector Delivery," Nat. Biotechnol. 25(11):1298-1306 (2007).

Lorenz, R., et al., "ViennaRNA Package 2.0," Algorithms for Molecular Biology 6:26 (2011).

Maeder, M. L., et al., "CRISPR RNA-Guided Activation of Endogenous Human Genes," Nat. Methods 10:977-979 (2013).

Maeder, M. L., et al., "Rapid "Open-Source" Engineering of Customized Zinc-Finger Nucleases for Highly Efficient Gene Modification," Mol. Cell 31(2):294-301 (2008).

Makarova, K. S., et al., "A Putative RNA-Interference-Based Immune System in Prokaryotes: Computational Analysis of the Predicted Enzymatic Machinery, Functional Analogies with Eukaryotic RNAi, and Hypothetical Mechanisms of Action," Biol. Direct. 1:7 (2006).

Makarova, K. S., et al., "Unification of Cas Protein Families and a Simple Scenario for the Origin and Evolution of CRISPR-Cas Systems," Biol. Direct 6:38 (2011).

Makarova, K.S., et al., "Evolution and Classification of the CRISPR-Cas Systems," Nat. Rev. Microbiol. 9(6):467-477 (2011).

Mali, P., et al., "CAS9 Transcriptional Activators for Target Specificity Screening and Paired Nickases for Cooperative Genome Engineering," Nat. Biotechnol. 31:833-838 (2013).

Mali, P., et al., "Cas9 as a Versatile Tool for Engineering Biology," Nat. Methods 10(10):957-963 (2013).

Mali, P., et al., "RNA-Guided Human Genome Engineering Via Cas9," Science 339(6121):823-826 (2013).

Marteijn, J.A., et al., "Understanding Nucleotide Excision Repair and Its Role in Cancer and Ageing," Nat. Rev. Mol. Cell Biol. 15(7):465-481 (2014).

Mathews, D. H., et al., "Expanded Sequence Dependence of Thermodynamic Parameters Improves Prediction of RNA Secondary Structure," J. Mol. Biol. 288:911-940 (1999).

Miller, J. C., et al., "An Improved Zinc-Finger Nuclease Architecture for Highly Specific Genome Editing," Nat. Biotechnol. 25:778-785 (2007).

Miller, J. C., et al., "A Tale Nuclease Architecture for Efficient Genome Editing," Nat. Biotechnol. 29(2):143-150 (2011).

Miyagishim M., et al., "U6 Promoter-Driven siRNAs with Four Uridine 3' Overhangs Efficiently Suppress Targeted Gene Expression in Mammalian Cells," Nat. Biotechnol. 20(5):497-500 (2002).

Mornex, J. F., et al., "Expression of the Alpha-1-Antitrypsin Gene in Mononuclear Phagocytes of Normal and Alpha-1-Antitrypsin-Deficient Individuals," J. Clin. Invest. 77(6):1952-1961 (1986).

Moscou, M. J., et al., "A Simple Cipher Governs DNA Recognition by TAL Effectors," Science 326(5959):1501 (2009).

Mulgrew, A. T., et al., "Z Alpha1-Antitrypsin Polymerizes in the Lung and Acts as a Neutrophil Chemoattractant," Chest 125(5):1952-1957 (2004).

Myers, E. W., et al., "Optimal Alignments in Linear Space," Comput. Appl. Biosci. 4(1):11-17 (1988).

Nakamura, Y., et al., "Codon Usage Tabulated From International DNA Sequence Databases: Status for the Year 2000," Nucl. Acids Res. 28(1):292 (2000).

Needleman, S. B., et al., "A General Method Applicable to the Search for Similarities in the Amino Acid Sequence of Two Proteins," J. Mol. Biol. 48(3):443-453 (1970).

Nishimasu, H., et al., "Crystal Structure of Cas9 in Complex with Guide RNA and Target DNA," Cell 156(5):935-949 (2014).

Nishimasu, H., et al., "Crystal Structure of *Staphylococcus aureus* Cas9," Cell 162:1113-1126 (2015).

Nishimasu, H., et al., "Engineered CRISPR-Cas9 Nuclease with Expanded Targeting Space," Science 361(6408):1259-1262 (2018).

Pattanayak, V., et al., "High-Throughput Profiling of Off-Target DNA Cleavage Reveals RNA-Programmed Cas9 Nuclease Specificity," Nat. Biotechnol. 31:839-843 (2013).

Pattanayak, V., et al., "Revealing Off-Target Cleavage Specificities of Zinc-Finger Nucleases by In Vitro Selection," Nat. Methods 8:765-770 (2011).

Patterson, S. S., et al., "Codon Optimization of Bacterial Luciferase (lux) for Expression in Mammalian Cells," J. Ind. Microbio. Biotechnology 32:115-123 (2005).

Pearson, W. R., et al., "Improved Tools for Biological Sequence Comparison," Proc. Natl. Acad. Sci. U.S.A. 85(8):2444-2448 (1988).

Pellissier, L. P., et al., "Specific Tools for Targeting and Expression in Muller Glial Cells," Mol. Ther. Methods Clin. Dev. 1:14009 (2014).

Peng, R., et al., "Potential Pitfalls of CRISPR/Cas9-Mediated Genome Editing," FEBS J. 283:1218-1231 (2016).

Perez, E. E., et al., "Establishment of HIV-1 Resistance in CD4+ T Cells by Genome Editing Using Zinc-Finger Nucleases," Nat. Biotechnol. 26:808-816 (2008).

Porteus, M. H., et al., "Gene Targeting Using Zinc Finger Nucleases," Nat. Biotechnol. 23(8):967-973 (2005).

Pougach, K., et al., "Transcription, Processing and Function of CRISPR Cassettes in *Escherichia coli*," Mol. Microbiol. 77(6):1367-1379 (2010).

Pride, D. T., et al., "Analysis of Streptococcal CRISPRs from Human Saliva Reveals Substantial Sequence Diversity Within and Between Subjects Over Time," Genome Res. 21:126-136 (2011).

Purnick, P. E. M., et al., "The Second Wave of Synthetic Biology: From Modules to Systems," Nat. Rev. Mol. Cell Biol. 10(6):410-422 (2009).

Qi, L. S., et al., "Repurposing CRISPR as an RNA-Guided Platform for Sequence-Specific Control of Gene Expression," Cell 152:1173-1183 (2013).

Qi, L., et al., "RNA Processing Enables Predictable Programming of Gene Expression," Nat. Biotechnol. 30(10):1002-1007 (2012).

Quinlan, A. R., et al., "BEDTools: A Flexible Suite of Utilities for Comparing Genomic Features," Bioinformatics 26(6):841-842 (2010).

Ran, F.A., et al., "Double Nicking by RNA-Guided CRISPR Cas9 for Enhanced Genome Editing Specificity," Cell 154(6):1380-1389 (2013).

(56) References Cited

OTHER PUBLICATIONS

Ran, F. A., et al., "In Vivo Genome Editing Using *Staphylococcus aureus* Cas9," Nature 520(7546):186-191 (2015).
Rand, T. A., et al., "Argonaute2 Cleaves the Anti-Guide Strand of siRNA During RISC Activation," Cell 123:621-629 (2005).
Raymond, C. S., et al., "High-Efficiency FLP and PhiC31 Site-Specific Recombination in Mammalian Cells," PLoS One 2(1):e162 (2007).
Rebar, E. J., et al., "Zinc Finger Phage: Affinity Selection of Fingers with New DNA-Binding Specificities," Science 263(5147):671-673 (1994).
Rebar, E. J., et al., "Induction of Angiogenesis in a Mouse Model Using Engineered Transcription Factors," Nat. Med. 8(12):1427-1432 (2008).
Recht, M. I., et al., "Monitoring Assembly of Ribonucleoprotein Complexes by Isothermal Titration Calorimetry," Methods in Mol. Biol. 488:117-127 (2008).
Regalado, A., "Who Owns the Biggest Biotech Discovery of the Century?," MIT Technology Review, Dec. 4, 2014, http://www.technologyreview.com/featuredstory/532796/who-owns-the-biggest--biotech-discovery-of-the-century/.
Reyon, D., et al., "FLASH Assembly of TALENs for High-Throughput Genome Editing," Nat. Biotech. 30:460-465 (2012).
Rho, M., et al. "Diverse CRISPRs Evolving in Human Microbiomes." PLoS Genetics 8(6):e1002441 (2012).
Richardson, C. D., et al., "Enhancing Homology-Directed Genome Editing by Catalytically Active and Inactive CRISPR-Cas9 Using Asymmetric Donor DNA," Nat. Biotechnol. 34(3):339-344 (2016).
Sander, J. D., et al., "Zinc Finger Targeter (ZiFiT): An Engineered Zinc Finger/Target Site Design Tool," Nucleic Acids Res. 35:W599-W605 (2007).
Sander, J. D., et al., "ZiFiT (Zinc Finger Targeter): An Updated Zinc Finger Engineering Tool," Nucleic Acids Res. 38:W462-468 (2010).
Sander, J. D., et al., "CRISPR-Cas Systems for Editing, Regulating and Targeting Genomes," Nat. Biotechnol. 32(4):347-355 (2014).
Sanders, R., "Cheap and Easy Technique to Snip DNA Could Revolutionize Gene Therapy", Berkeley News Online, pp. 1-3 (Jan. 7, 2013).
Sandhaus et al., "The Diagnosis and Management of Alpha-1 Antitrypsin Deficiency in the Adult", Chronic Obstr Pulm Dis 3(3)668-682 (2016).
Sanjana, N. E., et al., "A Transcription Activator-Like Effector (TALE) Toolbox for Genome Engineering," Nat. Protoc. 7(1):171-192 (2012).
Sapranauskas, R., et al., "The *Streptococcus thermophilus* CRISPR-Cas System Provides Immunity in *Escherichia coli*," Nucl. Acids Res.39:9275-9282 (2011).
Sather, B. D., et al., "Efficient Modification of CCR5 in Primary Human Hematopoietic Cells Using a Mega TAL Nuclease and AAV Donor Template," Sci. Trans. Med. 7(307):307ra156 (2015).
Schramm, L., et al., "Recruitment of RNA Polymerase III to Its Target Promoters," Genes Devel. 16:2593-2620 (2002).
Selleck, W., et al., "Biophysical Characterization and Direct Delivery of *S. pyogenes* Cas9 Ribonucleoprotein Complexes," Editas Medicine, Apr. 27, 2015, retrieved from URL http://www.editasmedicine.com/documents/ASGCT_poster_2015_Will.pdf.
Shalem, O., et al., "Genome-Scale CRISPR-Cas9 Knockout Screening in Human Cells," Science 343:84 (2014).
Shanks, P., "CRISPR Opportunities . . . for What? and for Whom?," Biopolitical Times, Dec. 4, 2014, http://www.biopoliticaltimes.org/article.php?id=8235.
Sharma, R., et al., "In Vivo Genome Editing of the Albumin Locus as a Platform for Protein Replacement Therapy," Blood 126(15):1777-1784 (2015).
Shayakhmetov, D. M., et al., "Analysis of Adenovirus Sequestration in the Liver, Transduction of Hepatic Cells, and Innate Toxicity after Injection of Fiber-Modified Vectors," J. Virol. 78(10):5368-5381 (2004).
Shen, B., et al., "Generation of Gene-Modified Mice via Cas9/RNA-Mediated Gene Targeting," Cell Res. 23:720-723 (2013).
Shmakov, S., et al., "Discovery and Functional Characterization of Diverse Class 2 CRISPR-Cas Systems," Mol. Cell 60(3):385-397 (2015).
Sifers, R. N., et al., "Tissue Specific Expression of the Human Alpha-1-Antitrypsin Gene in Transgenic Mice," Nucleic Acids Res. 15(4):1459-1475 (1987).
Smith, C., et al., "Efficient and Allele-Specific Genome Editing of Disease Loci in Human iPSCs," Mol. Ther. 23(3):570-577 (2015).
Smith, T. F., et al., "Comparison of Biosequences," Adv. Appl. Math. 2(4):482-489 (1981).
Sontheimer, E., "Project 7: Establishing RNA-Directed DNA Targeting in Eukaryotic Cells; Project dates: Nov. 16, 2011 to Dec. 31, 2012," Physical Sciences—Oncology Center (Feb. 4, 2012).
Sternberg, S.H., et al., "DNA Interrogation by the CRISPR RNA-Guided Endonuclease Cas9," Nature 507(7490):62-67 (2014).
Strecker, J., et al., "Engineering of CRISPR-Cas12b for Human Genome Editing," Nat. Commun. 10:212 (2019).
Sugimoto, N., et al., "Thermodynamic Parameters to Predict Stability of RNA/DNA Hybrid Duplexes," Biochem. 34:11211-11216 (1995).
Sugimoto, N., et al., "Thermodynamics-Structure Relationship of Single Mismatches in RNA/DNA Duplexes," Biochem. 39(37):11270-11281 (2000).
Sveger, T., "The Natural History of Liver Disease in Alpha 1-Antitrypsin Deficient Children," Acta Paediatr. Scand. 77:847-851 (1988).
Szczepek, M., et al., "Structure-Based Redesign of the Dimerization Interface Reduces the Toxicity of Zinc-Finger Nucleases," Nat. Biotechnol. 25:786-793 (2007).
Tang, L., et al., "CRISPR/Cas9-Mediated Gene Editing in Human Zygotes Using Cas9 Protein," Mol. Genet. Genom. 292(3):525-533 (2017).
Teng, F., et al., "Repurposing CRISPR-Cas12b for Mammalian Genome Engineering," Cell Discov. 4:63 (2018).
Terns, M. P., et al., "CRISPR-based Adaptive Immune Systems," Curr. Opin. Microbiol. 14:321-327 (2011).
Thurman, R. E., et al., "The Accessible Chromatin Landscape of the Human Genome," Nature 489(7414):75-82 (2012).
Tolia, N. H., et al., "Slicerand the Argonautes," Nat. Chem. Biol. 3(1):36-43 (2007).
Tolpin, Thomas W., Third Party Observation for EP13793997.1, Jan. 6, 2015, 50 pages.
Truong, L. N., et al., "Microhomology-Mediated End Joining and Homologous Recombination Share the Initial End Resection Step to Repair DNA Double-Strand Breaks in Mammalian Cells," PNAS 110(19):7720-7725 (2013).
Tsai, S. Q., et al., "Dimeric CRISPR RNA-Guided FokI Nucleases for Highly Specific Genome Editing," Nat. Biotechnol. 32(6):569-576 (2014).
Tsai, S.Q., et al., "Open-Source GuideSeq Software for Analysis of GUIDE-Seq Data," Nat. Biotechnol. 34(5):483 (2016).
Urnov, F. D., et al., "Highly Efficient Endogenous Human Gene Correction Using Designed Zinc-Finger Nucleases," Nature 435:646-651 (2005).
Van Der Oost, J., "New Tool for Genome Surgery," Science 336:768-768 (2013).
Van Der Ploeg, J. R., "Analysis of CRISPR in *Streptococcus mutans* Suggests Frequent Occurrence of Acquired Immunity Against Infection by M102-Like Bacteriophages," Microbiology 155:1966-1976 (2009).
Van Overbeek, M., et al., "DNA Repair Profiling Reveals Nonrandom Outcomes at Cas9-Mediated Breaks," Mol. Cell 63:633-646 (2016).
Volpert, D., et al., "Alpha1-Antitrypsin Deficiency-Associated Liver Disease Progresses Slowly in Some Children," J. Pediatr. Gastroenterol. Nutr. 31:258-263 (2000).
Wang, H., et al., "One-Step Generation of Mice Carrying Mutations in Multiple Genes By CRISPR/Cas-Mediated Genome Engineering," Cell 153(4):910-918 (2013).
Wang, J., et al., "Homology-Driven Genome Editing in Hematopoietic Stem and Progenitor Cells Using ZFN mRNA and AAV6 Donors," Nat. Biotechnol. 33(12):1256-1263 (2015).

(56) References Cited

OTHER PUBLICATIONS

Wang, J., et al., "Highly Efficient Homology-Driven Genome Editing in Human T Cells by Combining Zinc-Finger Nuclease mRNA and AAV6 Donor Delivery," Nucleic Acids Res. 44(3):e30 (2016).
Wang, T., et al., "Genetic Screens in Human Cells Using the CRISPR-Cas9 System," Science 343(6166):80-84 (2013).
Wang, J., et al., "xCas9 Expands the Scope of Genome Editing with Reduced Efficiency in Rice," Plant Biotechnol. J. 17:709-711 (2019).
Wiedenheft, B., et al., "RNA-Guided Genetic Silencing Systems in Bacteria and Archaea," Nature 482:331-338 (2012).
Wu, X., et al., "Genome-Wide Binding of the CRISPR Endonuclease Cas9 in Mammalian Cells," Nat. Biotechnol. 32(7):670-676 (2014).
Wu, Y., et al., "Correction of a Genetic Disease in Mouse via Use of CRISPR-Cas9," Cell Stem Cell 13(6):659-662 (2013).
Xiao, A., et al., "CasOT: A Genome-Wide Cas9/gRNA Off-Target Searching Tool," Bioinformatics 30(8):1180-1182 (2014).
Xu, Q., et al., "Design of 240,000 Orthogonal 25mer DNA Barcode Probes," Proc. Natl. Acad. Sci.106(7):2289-2294 (2009).
Yamano, T., et al., "Crystal Structure of Cpf1 in Complex with Guide RNA and Target DNA," Cell 165(4):949-962 (2016).
Yan, W. X., et al., "Functionally Diversse Type V CRISPR-Cas Systems," Science 363:88-91 (2019).
Yang, H., et al., "One-Step Generation of Mice Carrying Reporter and Conditional Alleles by CRISPR/Cas-Mediated Genome Engineering," Cell 154(6):1370-1390 (2013).
Zetsche, B., et al., "A Split-Cas9 Architecture for Inducible Genome Editing and Transcription Modulation," Nat. Biotechnol. 33(2):139-142 (2015).
Zetsche, B., et al., "Cpf1 Is a Single RNA-Guided Endonuclease of a Class 2 CRISPR-Cas System," Cell 163(3):759-771 (2015).
Zou, J., et al., "Gene Targeting of a Disease-Related Gene in Human Induced Pluripotent Stem and Embryonic Stem Cells," Cell Stem Cell 5(1):97-110 (2009).
European Patent Office, International Search Report and Written Opinion dated Jun. 24, 2015 for PCT/US2015/019064.
European Patent Office, International Search Report and Written Opinion dated Jul. 1, 2015 for PCT/US2015/019790.
European Patent Office, International Search Report and Written Opinion dated Sep. 28, 2015 for PCT/US2015/022856.
European Patent Office, International Search Report and Written Opinion dated Jul. 31, 2015 for PCT/US2015/022851.
European Patent Office, International Search Report and Written Opinion dated Aug. 10, 2015 for PCT/US2015/023906.
European Patent Office, International Search Report and Written Opinion dated Jun. 12, 2017 for PCT/US2017/024163.
European Patent Office, International Search Report and Written Opinion dated Jul. 28, 2016 for PCT/US2016/029252.
European Patent Office, International Search Report and Written Opinion dated May 29, 2017 for PCT/US2017/022377.
European Patent Office, International Search Report and Written Opinion dated Oct. 26, 2017 for PCT/US2017/045191.
European Patent Office, Examination Report for EP 13824232.6, dated Dec. 16, 2014, 4 pages.
United States Patent and Trademark Office, International Search Report and Written Opinion for PCT/US2013/075317, dated Apr. 15, 2014, 12 pages.
United States Patent and Trademark Office, International Search Report and Written Opinion for PCT/US2013/075326, dated Aug. 22, 2014, 13 pages.
United States Patent and Trademark Office, International Search Report and Written Opinion for PCT/US2014/027335, dated Jul. 16, 2014, 13 pages.
United States Patent and Trademark Office, International Search Report and Written Opinion for PCT/US2014/028630, dated Jul. 24, 2014, 9 pages.
Bothmer, A., et al., "Detection and Modulation of DNA Translocations During Multi-Gene Genome Editing in T Cells,"The CRISPR Journal 3(3):177-187 (2020).
Cost, G. J., et al., Geneseq Accession No. BBD49192 (2014), 2 pages.
Fu, B. X. H., et al., "Landscape of Target: Guide Homology Effects on Cas9-Mediated Cleavage," Nucl. Acids Res. 42(22):13778-13787 (2014).
Giannoukos, G., et al., "UDiTaS™, a genome editing detection method for indels and genome rearrangements," BMC Genomics 19:212 (2018).
Kleinstiver, B. P., et al., "Engineered CRISPR-Cas12a variants with increased activities and improved targeting ranges for gene, epigenetic and base editing," Nat. Biotechnol. 37(3):276-282 (2019).
Kosicki, M., et al., "Repair of Double-Strand Breaks Induced by CRISPR-Cas9 Leads to Large Deletions and Complex Rearrangements," Nat. Biotechnol. 36(8):765-771 (2018).
Krieg, A. M., et al., GeneSeq Accession No. BAY71542 (2013).
Pausch, P., et al., "CRISPR-CasΦ from Huge Phages is a Hypercompact Genome Editor," Science ;369(6501):333-337 (2020).
Reeks, J., et al., "Structure of a Dimeric Crenarchaeal Cas6 Enzyme with an Atypical Active Site for CRISPR RNA Processing," Biochem. J. 452:223-230 (2013).
Strohkendl, I., et al., "Kinetic Basis for DNA Target Specificity of CRISPR-Cas12a,"Mol Cell. 71(5):816-824 (2018).
Swarts, D. C., et al., "Cas9 Versus Cas12a/Cpf1: Structure-Function Comparisons and Implications for Genome Editing," WIREs RNA 9:e1481 (2018).
Vidigal, J. A., et al.," Rapid and Efficient One-Step Generation of Paired gRNA CRISPR-Cas9 Libraries," Nat. Commun. 6:8083 (2015).

\* cited by examiner

Fig. 1G

Alignment

```
S. pyogenes     5'-NNNNNNNNNNNNNNNNNNNNGUUUUAGAGCUAGCUGUUUG-3'     (SEQ ID NO:39)
S. thermophilus 5'-NNNNNNNNNNNNNNNNNNNNGUUUUAGAGCUGUGUGUUUG-3'     (SEQ ID NO:45)
                                        ************ ** ***** *

S. pyogenes     5'-GAACCAUUCAAAACAGCAUAGCAAGUUAAAAUAAGGC-UAGUCCGUUAUCAACUUGAAAAAGUGGCACCGAGUCGGUGCUUUUUU-3'
S. thermophilus 5'------GGGCGAAACAACACAGCGAGUUAAAAUAAGGCUUAGUCCGUACUCAACUUGAAAAGGUGGCACCGAUUCGGUGUUUUU---3'
                        * ***** ** *** *****************  ********  **********  **********  ****** ****

S. pyogenes - cont      (SEQ ID NO:47)
S. thermophilus - cont  (SEQ ID NO:46)
```

Fig. 1H

```
NNNNNNNNNNNNNNNNNNNNNNGUUUA GA GCUAG
                      ||||||   ||||  A
                                     A
                   C GGAAUAAAAUUGAACGAUA
               U| ||
               A GUCCGUUAUCAACUUG
                                ||||  A
                                      A
                        AGCCACGGUGAAA
                     G ||||||
                        UCGGUGCUUUUUU    (SEQ ID NO:42)
```

Fig. 11

```
NNNNNNNNNNNNNNNNNNNNNGUUUUAGUA C UCUGG
                     ||||||||  |||| A
         ACGGAACAAAUCAUCUAAGACA      A
       A ||||                        
      A  UGCCGUGUUUAUCUCGUCAAC
      A          ||||||| ||||U
                 UUUUUUAGAGCGGUUG  U   (SEQ ID NO:38)
```

Fig. 2A

```
CLUSTAL format alignment by MAFFT (v7.058b)
                                                            Y
                               *
SM          MKKPYSIGLDIGTNSVGWAVVTDDYKVPAKKMKVLGNTDKSHIEKNLLGALLFDSGNTAED
SP          MDKKYSIGLDIGTNSVGWAVITDEYKVPSKKFKVLGNTDRHSIKKNLIGALLFDSGETAEA
ST          MTKPYSIGLDIGTNSVGWAVITDNYKVPSKKMKVLGNTSKKYIKKNLLGVLLFDSGITAEG
LI          MKKPYTIGLDIGTNSVGWAVLTDQYDLVKRKMKIAGDSEKKQIKKNFWGVRLFDEGQTAAD
             * *;*** **********  **;*. ;  ;*;*;  *;:.;   *;**; *. ***.* **
Motif:      M-K-Y*IGLDIGTNSVGWAV-TD*Y-*---K*K*-G**-*--I*KN*-G--LFD-G-TA--

SM          RRLKRTARRRYTRRRNRILYLQEIFSEEMGKVDDSFFHRLEDSFLVTEDKRGERHPIFGN
SP          TRLKRTARRRYTRRKNRICYLQEIFSNEMAKVDDSFFHRLEESFLVEEDKEHERHPIFGN
ST          RRLKRTARRRYTRRRNRILYLQEIFSTEMATLDDAFFQRLDDSFLVPDDKRDSKYPIFGN
LI          RRMARTARRRIERRRNRISYLQGIFAEEMSKTDANPFCRLSDSFYVDNEKRNSRHPFFAT
             *;  ******  **;*** *** **; **.. *  ** **.;** *  ;:*;  .;:*;*..
Motif:      -R*-RTARRR--RR*NRI-YLQ-IF*-EM---D--FF-RL-*SF-V-**K*--**P*F--

SM          LEEEVKYHENFPTIYHLRQYLADNPEKVDLRLVYLALAHIIKFRGHFLIEGKFDTRNNDV
SP          IVDEVAYHEKYPTIYHLRKKLVDSTDKADLRLIYLALAHMIKFRGHFLIEGDLNPDNSDV
ST          LVEEKAYHDEFPTIYHLRKYLADSTKKADLRLVYLALAHMIKYRGHFLIEGEFNSKNNDI
LI          IEEEVEYHKNYPTIYHLREELVNSSEKADLRLVYLALAHIIKYRGNFLIEGALDTQNTSV
             ; ;*  **.;;*******;  *.;,.*,****;******;**;**;*****  ;:. *..;
Motif:      *--*E--YH-**PTIYHLR*-L-*---K-DLRL*YLALAH*IK*RGNFLIEG-**--N--*
```

Fig. 2B

```
SM      QRLFQEFLAVYDNTFENSS------LQEQNVQVEEILTDKISKSAKKDRVLKLFPNEKSN
SP      DKLFIQLVQTYNQLFEENP------INASGVDAKAILSARLSKSRRLENLIAQLPGEKKN
ST      QRNFQDFLDTYNAIFESDL------SLENSKQLEEIVKDKISKLEKKDRILKLFPGEKNS
LI      DGIYKQFIQTYNQVFASGIEDGSLKKLEDNKDVAKILVEKVTRKEKLERILKLYPGEKSA
          :  :::  .*: *  ..      ..  *: :::: : :.::  *.**.
Motif:  *--*-****--Y*--f--------------------*---I*--****--*-*-**---P-EK--

SM      GRFAEFLKLIVGNQADPKKHFELEEKAPLQFSKDTYEEELEVLLAQIGDNYAELPLSAKK
SP      GLFGNLIALSLGLTPNFKSNFDLARDAKLQLSKDTYDDDLDNLLAQIGDQYADLPLAAKN
ST      GIFSEFLKLIVGNQADPRKCFNLDEKASLHPSKESYDEDLETLLGYIGDDYSDVFLKAKK
LI      GSMFAQFISLIVGSKGNFQKPFDLIEKSDIKCAKDSYEEDLESLLALIGDEYAELFVAAKN
         * *.::: * :*    ;*:. *:* *.: :. ;*::*:::*; **. ***:*:::*: **:
Motif:  G-F-***-L-*G---*F*--F*L-E-*-*---*KY*L*-LL--IGD*Y***F*-AK*

SM      LYDSILLSGILTVTDVGTKAPLSASMIQRYNEHQMDLAQLKQFIRQKLSDKYNEVFSDVS
SP      LSDAILLSDILRVNTEITKAPLSASMIKRYDEHHQDLTLLKALVRQQLPEKYKEIFFDQS
ST      LYDAILLSGFLTVTDNETEAPLSSAMIKRYNEHKEDLALLKEYIRNISLKTYNEVFKDDT
LI      AYSAVVLSSIITVAETETNAKLSASMIERFDTHEEDLGELKAFIKLHLPKHYEEIFSNTE
         .:::**.:: *    *:* **;:**;*:: *, ** **  ::  . *:*:* :
Motif:  ---*LS-*-V----T*A-LS**MI*R-H--DL--LK--------Y*E*F-*--

SM      KDGYAGYIDGKTNQEAFYKYLKGLLNKIEGSGYFLDKIEREDFLRKQRTFDNGSIPHQIH
SP      KNGYAGYIDGGASQEEFYKFIKPILEKMDGTEELLVKLNREDLLRKQRTFDNGSIPNIR
ST      KNGYAGYIDGKTNQEDFYVYLKKLLAEFEGADYFLEKIDREDFLRKQRTFDNGSIPYQIH
LI      KHGYAGYIDGKTKQADFYKYMEMTLENIEGADYFIAKIEKENFLRKQRTFDNGAIPHQLH
         *,********  :.*   **  ::*    *   :::*:   ::  *:::*:**********:**;*;*
Motif:  K-GYAGYIDG-*-Q--FY-K--L-*G*---K*E**LRKQRTFDNG*IP*Q*H
```

Fig. 2C

```
SM      LQEMRAIIRRQAEFYPPFLADNQDRIEKLLTFRIPYYVGPLARGKSDFAWLSRKSADKITP
SP      LGELHAILRRQEDFYPPLKDNREKIEKILTFRIPYYVGPLARGNSRFAWMTRKSEETITP
ST      LQEMRAILDKQAKFYPFLAKNKERIEKILTFRIPYYVGPLARGNSDFAWSIRKRNEKITP
LI      LEELEAILHQQAKYYPFLKENYDKIKSLVTFRIPYFVGPLANGQSEFAWLTRKADGEIRP
         *  *;  ** ;   :*   ; :****    .*    ;;*:;;;*******;*****.*;* *** **      * *
Motif:  L-E*-AI*-*Q--*YPFL--N-**I*-**TFRIPY*VGPLA-G*S-FAW--RK----I-P SM      WNFDEIVDKESSAEAFINRMTNYDLYLPNQKVLPKHSLLYEKFTVYNELTKVKYKTE-QG
SP      WNFEEVVDKGASAQSFIERMTNFDKNLPNEKVLPKHSLLYEYPTVYNELTKVKYVTEGMR
ST      WNFEDVIDKESSAEAFINRMTSFDLYLPEEKVLPKHSLLYETFNVYNELTKVRFIAESMR
LI      WNIEEKVDFGKSAVDFIEKMTNKDTYLPKENVLPKHSLCYQKYLVYNELTKVRYIND-QG
        **;::    :*      **   **;;**, *    **;;;:*******  *;  ;  ********;;    ;
Motif:  WN***-*D---SA--FI**MT--D---LP***VLPKHSL-Y*-*-VYNELTKV**--*---

SM      KTAFFDANMKQEIFDGVFKVYRKVTKDKLMDFLEKEFDEFRIVDLTGLDKENKVFNASYG
SP      KPAFLSGEQKKAIVDLLFKTNRKVTVKQLKEDYFKKIECFDSVEISGVEDR---PNASLG
ST      DYQFLDSKQKKDIVRLYFKDKRKVTDKDIIEYL-HAIYGYDQGIELKGIEKQ---FNSSLS
LI      KTSYFSGQEKEQIFNDLFKQKRKVKKKDLELFL-RNMSHVESPTIEGLEDS---FNSSYS
        .   ;;..; *; *.   **   ***. ..;       ;  ;     **;:.      **;* .
Motif:  ---**-*--K*--I----PK--RKV---*---*-*--------*-G**-----FN*S--

SM      TYHDLCKIL-DKDFLDNSKNEKILEDIVLTLTLFEDREMIRKRLENYSDLLTKEQVKKLE
SP      TYHDLLKIIKDKDFLDNEENEDILEDIVLTLTLFEDREMIEERLKTYAHLFDDKVMKQLK
ST      TYHDLLNIINDKEFLDDSSNEAIIEEIIHTLTIFEDREMIKQRLSKFENIFDKSVLKKLS
LI      TYHDLLKVGIKQEILDNFVNTEMLENIVKILTVFEDKRMIKEQLQQFSDVLDGVVLKKLE
        *****  ;;   .;;;**;   *    ;;*;*;    **;***;,**,;;*,  ;  .;;     ;*;*,
Motif:  TYHDL-**-.-***LD*--N-.-*E*I*--LT*FED*-MI-**L--*--**----*K*L-
```

Fig. 2D

```
SM      RRHYTGWGRLSAELIHGIRNKESRKTILDYLIDDQNSNRNFMQLINDDALSFKEEIAKAQ
SP      RRRYTGWGRLSRKLINGIRDKQSGKTILDFLKSDGFANRNFMQLIHDDSLTFKEDIQKAQ
ST      RRHYTGWGKLSAKLINGIRDEKSQNTILDYLIDDGISNRNFMQLIHDDALSFKKKIQKAQ
LI      RRHYTGWGRLSAKLLMGIRDKQSHLTILDYLMNDDGLNRNLMQLINDSNLSFKSIIBKEQ
        **;*****;** ;*; ***;;;* ****;* ,*, ***;****;*, *;**, * * *
Motif:  RR*YTGWG*LS-*L*-GIR***S--TILD*L---D---NRN*MQLI*D--L*FK--I-K-Q      [ 8 ]

SM      VIGETD--NLNQVVSDIAGSPAIKKGILQSLKIVDELVKIMG-HQPER[EVVEMARE]NQFT
SP      VSGQGD--SLHEHIANLAGSPAIKKGILQTVKVVDELVKVMGRHKPER[EVIEMARE]NQTT
ST      IIGDEDKGNIKEVVKSLPGSPAIKKGILQSIKIVDELVKVMGGRKPES[EVVEMARE]NQYT
LI      VTTADK--DIQSIVADLAGSPAIKKGILQSLKIVDELVSVMG-YPPQT[EVVEMARE]NQTT
        ;     , ,;;, ; ,;,************;;,****,;** *,;[**;****]** *
Motif:  *-------------*--GSPAIKKGILQ**K*VDELV-*MG---P*-[IV*EMARE]NQ-T SM      NQGRRNSQQRLKGLTDSIKEFGSQILKEH------PVENSQLQNDRLFLYYLQNGRDMYT
SP      QKGQKNSRERMKRIEPGIKELGSQILKEH------PVENTQLQNEKLYLYYLQNGRDMYV
ST      NQGKSNSQQRLKRLEKSLKELGSKILKENIPAKLSKIDNNALQNDRLYLYYLQNGKDMYT
LI      GKGKNNSRPRYKSLEKAIKEFGSQILKEH------PTDNQELRNNRLYLYYLQNGKDMYT
        ;*; **; * * ; ,,;**;**;****;       ;* *;*;;*;*********;***,
Motif:  -*G--NS*-R-K-*----*KE*GS*ILKE*---------*N--L*R**L*LYYLQNG*DMY-    [ G ]

SM      GEELDIDYLGQY[DIDNIIPQAFIKDNSIDNRVLTSSKEN]GKSDDVPSKDVVRKMKSYWS
SP      DQELDINRLSDY[DVDNIVPQSFLKDDSIDNKVLTRSDKN]GKSDNVPSEEVVKYMKNYWR
ST      GDDLDIDRLSNY[DIDNIIPQAFLKDNSIDNKVLVSSASN]GKSDDVPSLEVVKKRKTFWY
LI      GQDLDINNLSNY[DIDNIVPQSFITDNSIDNLVLTSSAGI]EKGDDVPPLEIVRKRKVFWE
        , ;***, **; ,*;,***;**;*;,*;**** **, *  ** *,*,**, ;;*;* * ;*
Motif:  -**LDI---LS*Y[D*DNI*PQ*F*-D*SIDN-VL--S--][N]-K-D*VP--**V*K-K-*W-
```

Fig. 2E

```
SM      KLLSAKLITQRKFDNLTKAERGGLTDDDKAGFIKRQLVETRQITKHVARILDERFNTETD
SP      QLLNAKLITQRKFDNLTKAERGGLSELDKAGFIKRQLVETRQITKHVAQILDSRMNTKYD
ST      QLLKSKLISQRKFDNLTKAERGGLSPEDKAGFIQRQLVETRQITKHVARLLDEKFMNKKD
LI      KLYQGNLMSKRKFDYLTKAERGGLTEADKARFIHRQLVETRQITENVANILHQRFNYEKD
        :*  ..*::.****.*********;.***.**;***********;**.;*.::* : *
Motif:  *L---*L***RKFD-LTKAERGGL*---DKA-FI*RQLVETRQITK*VA--*L--**N-*-D                    [B]

SM      ENNKKIRQVKIVTLKSMLVSNFRKEFELYKVREINDYHHAHDAYLNAVIGKALLGVYPQL
SP      ENDKLIREVKVITLKSKLVSDFRKDFQFYKVREINNYHHAHDAYLNAVVGTALIKKYPKL
ST      ENNRAVRTVKIITLKSTLVSQFRKDFELYKVREINDFHHAHDAYLNAVVASALLKKYPKL
LI      DHGNTMKQVRIVTLKSALVSQFRKQFQLYKVRDVNDYHHAHDAYLNGVVANTLLKVYPQL
        :... ::..*:;:****.***.*:;****.;;****:*:j********:.*;..:*; **:*
Motif:  ----V***TLKS-LVS*FRK*FLYKVN**HHAHDAYLN-V*---*L---YP*L SM      EPEFVYGDYPHFNGHKE--------NK-ATAKKFFYSNIMNFFKKDDVRTD---------
SP      ESEFVYGDYKVYDVRKMIAKSEQEIGK-ATAKYFFYSNIMNFFKTEITLARGEIRKRPLI
ST      EPEFVYGDYPKYNSFRE--------RKSATEKVYFYSNIMNIPKKSISLADGRVIERPLI
LI      EPEFVYGDYHQFSWFKA--------NK-ATAKQFYTNIMLFFAQKDRIID---------
        *.*******  :.  :            * ** *  **;***.:* .    :
Motif:  E-EFVYGDY--*---*--------K-AT-K--FY*NIM-*F--------*--------

SM      ----KNGELIWKKDEHISNIKKVLSYPQVNIVKKVEEQTGGFSKE----------SILPK
SP      ETNGETGEIVWDKGRDFATVRKVLSMPQVNIVKKTEVQTGGFSKE----------SILPK
ST      EVNEETGESVWNKESDLATVRRVLSYPQVNIVKKVEEQNHGLDRGKPKGLFNANLSSKPK
LI      ----ENGEILWDK-KYLDTVKKVRSYRQMNIVKKTEIQKGEFSKA----------TIKPK
        ;.** :*.*   :  .:;:*:*  *:*;***.* *.  .:             :  **
Motif:  -----*-GE-*W-K---*---***V*M--Q*N*VKK-E-Q---*-*-----------*---PK
```

Fig. 2F

```
SM      GNSDK-LIPRKTKKFYWDTKKYGGFDSPIVAYSILVIADIEKGKSKKLKTVKALVGVTIM
SP      RNSDK-LIARKKD---WDPKKYGGFDSPTVAYSVLVVAKVEKGKSKKLKSVKELLGITIM
ST      PNSNENLVGAKEY---LDPKKYGGYAGISNSFTVLVKGTIEKGAKKKITNVLEFQGISIL
LI      GNSSK-LIPRKTN---WDPMKYGGLDSPNMAYAVVI--EYAKGKN-KLVFEKKIIRVTIM
          **.: *; *       *. ****   .  :::::;   ** . *;    :  ::*;
Motif:  -NS-*-L*--K-----D--KYGG------*******-----KG---K*-----*---**I*

SM      EKMTPERDPVAPLERKGYRNVQEENIIKLPKYSLFKLENGRKRLLAS-------ARELQK
SP      ERSSFEKNPIDFLEAKGYKEVKKDLIIKLPKYSLFELENGRKRMLAS-------AGELQK
ST      DRINYRKDKLNFLLEKGYKDI--ELIIELPKYSLFELSDGSRRMLASILSTNNKRGEIHK
LI      ERKAFEKDEKAFLEEQGYRQP--KVLAKLPKYTLYECEEGRRRMLAS-------ANEAQK
         ::  :.;;   **  ;**;;   . : ;****;*;;  .;* ;*;***       * ;*
Motif:  **---*--**---FL--*GY*------*-*LPKY*L**--*G-*R*LAS---------E-*K SM      GNEIVLPNHLGTLLYHAKNIHKV-------DEPKHLDYVDKHKDBFKELLDVVSNFSKKYT
SP      GNELALPSKYVNFLYLASHYEKLKGSPEDNEQKQL-FVEQHKHYLDEIIEQISEFSKRVI
ST      GNQIFLSQKFVKLLYHAKRISNT-------INENHRKYVKNHKKEFEELFYYILEFNENYV
LI      GNQQVLPNHLVTLLMHAANCEVS-------DGKSLDYIESNREMFAELLAHVSEFAKRYT
        **;  *.,:  .;*;  * .          ; : :::.:;. : *;;  :.;*. ;.
Motif:  GN*---L-*-*----*L*-A--------------*-------****-*-----E*----*-F-*----

SM      LAEGNLEKIKELYAQNNGEDLKELASSFI--------NLLTFTAIGAPATFKFFDKNIDR
SP      LADANLDKVLSAYNKHRDKPIREQAENII--------HLFTLTNLGAPAAFKYFDTTIDR
ST      GAKKNGKLLNSAFQSWQNHSIDELCSSFIGPTGSERKGLFELTSRGSAADFEFLGVKIPR
LI      LAEANLNKINQLFEQNKEGDIKAIAQSFV--------DLMAFNAMGAPASFKFFETTIER
        *. * , : . . .     :  ...;;         *; ;. *:.* *:;; .* *
Motif:  --A--N---*----*----*------*-------**---------L*-*---G*-A-F***---I-R
```

Fig. 2G

```
SM         KR-YTSTTEILNATLIHQSITGLYETRIDLNKLGGD       (SEQ ID NO:1)
SP         KR-YTSTKEVLDATLIHQSITGLYETRIDLSQLGGD       (SEQ ID NO:2)
ST         YRDYTPSSLLKDATLIHQSVTGLYETRIDLAKLGEG       (SEQ ID NO:4)
LI         KR-YNNLKELLNSTIIYQSITGLYESRKRLD----D       (SEQ ID NO:5)
              * *.   . :  ;;*;*;**;*****;*   *       .
Motif:     -R-Y-----*-**T*I*QS*TGLYE*R--L------       (SEQ ID NO:14)
```

Fig. 3A

Alignment of the N terminal RuvC-like Domains disclosed in Chylinski et al.
(excluding sequence outliers).
(CLUSTAL format alignment by MAFFT (v7.058b))

| | | |
|---|---|---|
| 1,12 | DIGTNSVGWAVT | (SEQ ID NO:120) |
| 3,20 | DVGTNSVGWAVT | (SEQ ID NO:121) |
| 15 | DMGTNSVGWAVT | (SEQ ID NO:122) |
| 4 | DVGTSSVGWAVT | (SEQ ID NO:123) |
| 7 | DIGTASVGWAVT | (SEQ ID NO:52) |
| 6 | DVGTGSVGWAVT | (SEQ ID NO:53) |
| 9 | DIGTNSVGWAVV | (SEQ ID NO:54) |
| 10 | DIGTNSVGWAVI | (SEQ ID NO:55) |
| 11 | DIGTNSVGWAVL | (SEQ ID NO:56) |
| 42 | DLGTNSIGWAVV | (SEQ ID NO:57) |
| 48 | DLGTNSIGWAI- | (SEQ ID NO:58) |
| 43 | DLGTNSIGWALV | (SEQ ID NO:59) |
| 2 | DIGTNSVGWCVT | (SEQ ID NO:60) |
| 14 | DIGTNSVGYAVT | (SEQ ID NO:61) |
| 5 | DMGTGSLGWAVT | (SEQ ID NO:62) |
| 16 | DIGTSSVGWAAI | (SEQ ID NO:63) |
| 8 | DLGTGSVGWAVV | (SEQ ID NO:64) |
| 22 | DLGVGSVGWAIV | (SEQ ID NO:65) |
| 23 | DLGIASIGWAII | (SEQ ID NO:66) |
| 24 | DLGIASVGWAIV | (SEQ ID NO:67) |
| 25 | DLGVASVGWSIV | (SEQ ID NO:68) |
| 26 | DIGIASVGWAIL | (SEQ ID NO:69) |
| 28 | DLGISSVGWSVI | (SEQ ID NO:70) |
| 32 | DIGIASVGWSVI | (SEQ ID NO:71) |
| 33 | DVGIGSIGWAVI | (SEQ ID NO:72) |
| 39 | DLGVGSIGFAIV | (SEQ ID NO:73) |
| 34 | DIGYASIGWAVI | (SEQ ID NO:74) |
| 47 | DTGTNSLGWAIV | (SEQ ID NO:75) |
| 50 | DLGTNSIGWCLL | (SEQ ID NO:76) |
| 49 | DIGTDSLGWAVF | (SEQ ID NO:77) |
| 18 | DIGSNSIGFAVV | (SEQ ID NO:78) |
| 41 | DLGVGSIGVAVA | (SEQ ID NO:79) |
| 45 | DLGIASCGWGVV | (SEQ ID NO:80) |

Fig. 3B

| | | |
|---|---|---|
| 21 | DLGIASVGWCLT | (SEQ ID NO:81) |
| 27 | DIGIGSVGVGIL | (SEQ ID NO:82) |
| 29 | DIGITSVGYGLI | (SEQ ID NO:83) |
| 30 | DIGITSVGFGII | (SEQ ID NO:84) |
| 31 | DVGITSTGYAVL | (SEQ ID NO:85) |
| 40 | DLGITSFGYAIL | (SEQ ID NO:86) |
| 17 | DIGNASVGWSAF | (SEQ ID NO:87) |
| 19 | DVGTNSCGWVAM | (SEQ ID NO:88) |
| 35 | DVGERSIGLAAV | (SEQ ID NO:89) |
| 36 | DVGLNSVGLAAV | (SEQ ID NO:90) |
| 37 | DVGLMSVGLAAI | (SEQ ID NO:91) |
| 38 | DVGTFSVGLAAI | (SEQ ID NO:92) |
| 13 | DIGTGSVGYACM | (SEQ ID NO:92) |
| 44 | DLGTTSIGFAHI | (SEQ ID NO:94) |
| 46 | DLGTNSIGSSVR | (SEQ ID NO:95) |
| | \* \* \* \* | |

Fig. 4A

Alignment of the N terminal RuvC-like Domains disclosed in Chylinski et al.
(CLUSTAL format alignment by MAFFT (v7.058b))

| | | |
|---|---|---|
| 1,12 | D----IGTNSVGWAVT | (SEQ ID NO:120) |
| 3,20 | D----VGTNSVGWAVT | (SEQ ID NO:121) |
| 15 | D----MGTNSVGWAVT | (SEQ ID NO:122) |
| 4 | D----VGTSSVGWAVT | (SEQ ID NO:123) |
| 7 | D----IGTASVGWAVT | (SEQ ID NO:52) |
| 6 | D----VGTGSVGWAVT | (SEQ ID NO:53) |
| 9 | D----IGTNSVGWAVV | (SEQ ID NO:54) |
| 10 | D----IGTNSVGWAVI | (SEQ ID NO:55) |
| 52 | D----IGTNSIGWAVI | (SEQ ID NO:96) |
| 11 | D----IGTNSVGWAVL | (SEQ ID NO:56) |
| 42 | D----LGTNSIGWAVV | (SEQ ID NO:57) |
| 48 | D----LGTNSIGWAI- | (SEQ ID NO:58) |
| 43 | D----LGTNSIGWALV | (SEQ ID NO:59) |
| 2 | D----IGTNSVGWCVT | (SEQ ID NO:60) |
| 14 | D----IGTNSVGYAVT | (SEQ ID NO:61) |
| 5 | D----MGTGSLGWAVT | (SEQ ID NO:62) |
| 16 | D----IGTSSVGWAAI | (SEQ ID NO:63) |
| 8 | D----LGTGSVGWAVV | (SEQ ID NO:64) |
| 23 | D----LGVGSVGWAIV | (SEQ ID NO:65) |
| 23 | D----LGIASIGWAII | (SEQ ID NO:66) |
| 24 | D----LGIASVGWAIV | (SEQ ID NO:67) |
| 68 | D----LGIASVGWAVV | (SEQ ID NO:97) |
| 25 | D----LGVASVGWSIV | (SEQ ID NO:68) |
| 26 | D----IGIASVGWAIL | (SEQ ID NO:69) |
| 66 | D----IGIASVGWAVL | (SEQ ID NO:98) |
| 59 | D----IGIASIGWAVI | (SEQ ID NO:99) |
| 61 | D----IGIASVGWAII | (SEQ ID NO:100) |
| 64 | D----VGIASVGWAVI | (SEQ ID NO:101) |
| 62 | D----IGIASVGWAL- | (SEQ ID NO:102) |
| 67 | D----IGIASVGWAMV | (SEQ ID NO:103) |
| 32 | D----IGIASVGWSVI | (SEQ ID NO:71) |
| 28 | D----LGISSVGWSVI | (SEQ ID NO:70) |
| 63 | D----IGITSVGWAVI | (SEQ ID NO:104) |

Fig. 4B

| | | |
|---|---|---|
| 33 | D----VGIGSIGWAVI | (SEQ ID NO:72) |
| 57 | D----LGISSLGWAIV | (SEQ ID NO:105) |
| 39 | D----LGVGSIGFAIV | (SEQ ID NO:73) |
| 34 | D----IGYASIGWAVI | (SEQ ID NO:74) |
| 50 | D----LGTNSIGWCLL | (SEQ ID NO:76) |
| 54 | D----LGTNSIGWGLL | (SEQ ID NO:106) |
| 47 | D----TGTNSLGWAIV | (SEQ ID NO:75) |
| 49 | D----IGTDSLGWAVF | (SEQ ID NO:77) |
| 51 | D----LGSTSLGWAIF | (SEQ ID NO:107) |
| 58 | D----IGISSIGWAFS | (SEQ ID NO:108) |
| 21 | D----LGIASVGWCLT | (SEQ ID NO:81) |
| 45 | D----LGIASCGWGVV | (SEQ ID NO:80) |
| 18 | D----IGSNSIGFAVV | (SEQ ID NO:78) |
| 65 | D----IGTTSIGFSVI | (SEQ ID NO:109) |
| 29 | D----IGITSVGYGLI | (SEQ ID NO:83) |
| 30 | D----IGITSVGFGII | (SEQ ID NO:84) |
| 44 | D----LGTTSIGFAHI | (SEQ ID NO:94) |
| 27 | D----IGIGSVGVGIL | (SEQ ID NO:82) |
| 41 | D----LGVGSIGVAVA | (SEQ ID NO:79) |
| 31 | D----VGITSTGYAVL | (SEQ ID NO:85) |
| 40 | D----LGITSFGYAIL | (SEQ ID NO:86) |
| 53 | D----IGTSSIGWWLY | (SEQ ID NO:110) |
| 55 | D----LGSNSLGWFVT | (SEQ ID NO:111) |
| 56 | D----LGANSLGWFVV | (SEQ ID NO:112) |
| 17 | D----IGNASVGWSAF | (SEQ ID NO:87) |
| 19 | D----VGTNSCGWVAM | (SEQ ID NO:88) |
| 35 | D----VGERSIGLAAV | (SEQ ID NO:89) |
| 36 | D----VGLNSVGLAAV | (SEQ ID NO:90) |
| 37 | D----VGLMSVGLAAI | (SEQ ID NO:91) |
| 38 | D----VGTFSVGLAAI | (SEQ ID NO:92) |
| 13 | D----IGTGSVGYACM | (SEQ ID NO:93) |
| 46 | D----LGTNSIGSSVR | (SEQ ID NO:95) |
| 60 | DIGLRIGITSCGWSI- | (SEQ ID NO:113) |
| 69 | D----MGAKYTGVFYA | (SEQ ID NO:114) |
| 73 | D----LGGKNTGFFSF | (SEQ ID NO:115) |
| 74 | D----LGVKNTGVFSA | (SEQ ID NO:116) |
| 70 | D----LGAKFTGVALY | (SEQ ID NO:117) |
| 71 | D----LGGKFTGVCLS | (SEQ ID NO:118) |
| 72 | D----LGGTYTGTFIT | (SEQ ID NO:119) |

Fig. 5A

Alignment of the HNH-like Domains disclosed in Chylinski et al.
(CLUSTAL format alignment by MAFFT (v7.058b))

```
1           YDIDHIYPRS-LTKD------DSF-DNLVLCERTAN    (SEQ ID NO:196)
2           -DIDHIYPRSKVIKD------DSF-DNLVLVLKNEN    (SEQ ID NO:197)
3           -DRDHIYPQS-KIKD------DSI-DNLVLVNKTYN    (SEQ ID NO:198)
4           -DIDHIYPRS-KIKD------DSI-TNRVLVEKDIN    (SEQ ID NO:195)
6           -DIDHIYPQS-KIKD------DSI-SNRVLVCSSCN    (SEQ ID NO:124)
5           -DIDHIYPQS-KTMD------DSL-NNRVLVKKNYN    (SEQ ID NO:125)
7           -DQDHIYPKS-KIYD------DSL-ENRVLVKKNLN    (SEQ ID NO:126)
8           -QIDHIVPQS-LVKD------DSF-DNRVLVVPSEN    (SEQ ID NO:127)
9           -DIDHIIPQA-FIKD------NSI-DNRVLTSSKEN    (SEQ ID NO:128)
12          -DIDHIIPQA-FLKD------NSI-DNKVLVSSASN    (SEQ ID NO:129)
16          -DIDHIIPQA-YTKD------NSL-DNRVLVSNITN    (SEQ ID NO:130)
11          -DIDHIVPQS-FITD------NSI-DNLVLTSSAGN    (SEQ ID NO:131)
10          -DVDHIVPQS-FLKD------DSI-DNKVLTRSDKN    (SEQ ID NO:132)
14          -NIDHIYPQS-MVKD------DSL-DNKVLVQSEIN    (SEQ ID NO:133)
18          -DIDHILPQS-LIKD------DSL-DNRVLVNATIN    (SEQ ID NO:134)
19          -DIDHILPQS-FIKD------DSL-ENRVLVKKAVN    (SEQ ID NO:135)
13          -EVDHIFPRS-FIKD------DSI-DNKVLVIKKMN    (SEQ ID NO:136)
15          -EVDHIIPRS-YIKD------DSF-ENKVLVYREEN    (SEQ ID NO:137)
17          -DIDHIIPQA-VTQN------DSI-DNRVLVARAEN    (SEQ ID NO:138)
22          -EIDHIIPYS-ISFD------DSS-SNKLLVLAESN    (SEQ ID NO:139)
24          -EIDHIIPYS-LCFD------DSS-ANKVLVHKQSN    (SEQ ID NO:140)
32          -DIDHIIPYS-RSMD------DSY-SNKVLVLSGEN    (SEQ ID NO:141)
63          -DIDHIIPYS-KSMD------DSF-NNKVLCLAEEN    (SEQ ID NO:142)
59          -EIDHIYPYS-RSFD------DSY-MNKVLVFTKQN    (SEQ ID NO:143)
65          -QIDHIYPYS-RSMD------DSY-MNKVLVLTDEN    (SEQ ID NO:144)
64          -EIDHIIPFS-RSFD------DSL-SNKILVLGSEN    (SEQ ID NO:145)
68          -EIDHALPFS-RTWD------DSF-NNKVLVLGSEN    (SEQ ID NO:146)
69          -EIDHALPFS-RTWD------DSF-NNKVLVLASEN    (SEQ ID NO:147)
28          -EIDHIIPIS-ISLD------DSI-NNKVLVLSKAN    (SEQ ID NO:148)
30          -EVDHIIPIS-ISLD------DSI-TNKVLVTHREN    (SEQ ID NO:149)
62          -QVDHALPYS-RSYD------DSK-NNKVLVLTHEN    (SEQ ID NO:150)
27          -EVDHILPLS-ITFD------DSL-ANKVLVYATAN    (SEQ ID NO:151)
26          -EIDHIIPRS-ISFD------DAR-SNKVLVYRSEN    (SEQ ID NO:152)
```

Fig. 5B

| | | |
|---|---|---|
| 29 | -EVDHIIPRS-VSFD------NSY-HNKVLVKQSEN | (SEQ ID NO:153) |
| 67 | -DIDHILPYS-ITFD------DSF-RNKVLVTSQEN | (SEQ ID NO:154) |
| 58 | -EIDHILPRS-RSAD------DSF-ANKVLCLARAN | (SEQ ID NO:155) |
| 51 | -EIEHLLPFS-LTLD------DSM-ANKTVCFRQAN | (SEQ ID NO:156) |
| 55 | -DIDHILPFS-VSLD------DSA-ANKVVCLREAN | (SEQ ID NO:157) |
| 57 | -DIDHLIPFS-ISWD------DSA-ANKVVCMRYAN | (SEQ ID NO:158) |
| 56 | -DIDHILPVA-MTLD------DSP-ANKIICMRYAN | (SEQ ID NO:159) |
| 54 | -DVDHILPYS-RTLD------DSF-PNRTLCLREAN | (SEQ ID NO:160) |
| 52 | -EIEHILPFS-RTLD------DSL-NNRTVAMRRAN | (SEQ ID NO:161) |
| 31 | -EVDHIIPYS-ISWD------DSY-TNKVLTSAKCN | (SEQ ID NO:162) |
| 45 | -QVDHILPWS-RFGD------DSY-LNKTLCTAKSN | (SEQ ID NO:163) |
| 53 | -QVDHILPFS-KTLD------DSF-ANKVLAQHDAN | (SEQ ID NO:164) |
| 60 | -QIDHAFPLS-RSLD------DSQ-SNKVLCLTSSN | (SEQ ID NO:165) |
| 21 | -DIDHIVPRS-ISFD------DSF-SNLVIVNKLDN | (SEQ ID NO:166) |
| 23 | -EIEHIIPYS-MSYD------NSQ-ANKILTEKAEN | (SEQ ID NO:167) |
| 25 | -EIDHVIPYS-KSAD------DSW-FNKLLVKKSTN | (SEQ ID NO:168) |
| 49 | -EMDHILPYS-RSLD------NGW-HNRVLVHGKDN | (SEQ ID NO:169) |
| 33 | -EVDHIVPYS-LILD------NTI-NNKALVYAEEN | (SEQ ID NO:170) |
| 42 | -EIEHVIPQS-LYFD------DSF-SNKVICEAEVN | (SEQ ID NO:171) |
| 43 | -DIEHIIPQA-RLFD------DSF-SNKTLEARSVN | (SEQ ID NO:172) |
| 44 | -EIEHIVPKA-RVFD------DSF-SNKTLTFHRIN | (SEQ ID NO:173) |
| 20 | -DKDHIIPQS-MKKD------DSIINNLVLVNKNAN | (SEQ ID NO:174) |
| 66 | -EVEHIWPRS-RSFD------NSP-RNKTLCRKDVN | (SEQ ID NO:175) |
| 61 | -IVNHIIPYN-RSFD------DTY-HNRVLTLTETK | (SEQ ID NO:176) |
| 46 | -DMEHTIPKS-ISFD------NSD-QNLTLCESYYN | (SEQ ID NO:177) |
| 47 | -DIEHTIPRS-AGGD------STK-MNLTLCSSRFN | (SEQ ID NO:178) |
| 48 | -DIEHTIPRS-ISQD------NSQ-MNKTLCSLKFN | (SEQ ID NO:179) |
| 50 | -DIDHVIPLA-RGGR------DSL-DNMVLCQSDAN | (SEQ ID NO:180) |
| 39 | -DIEHLFPIA-ESED------NGR-NNLVISHSACN | (SEQ ID NO:181) |
| 41 | -DVDHIFPRD-DTAD------NSY-GNKVAHRQCN | (SEQ ID NO:182) |
| 40 | -DIEHIVPQS-LGGL------STD-YNTIVTLKSVN | (SEQ ID NO:183) |
| 35 | -ELDHIVPRT-DGGS------NRH-ENLAITCGACN | (SEQ ID NO:184) |
| 36 | -EMDHIVPRKGVGST------NTR-TNFAAVCAECN | (SEQ ID NO:185) |
| 37 | -EMDHIVPRKGVGST------NTR-VNLAAACAACN | (SEQ ID NO:186) |
| 38 | -EMDHIVPRAGQGST------NTR-ENLVAVCHRCN | (SEQ ID NO:187) |
| 70 | -EIDHILPRS-LIKDARGIVFNAE-PNLIYASSRGN | (SEQ ID NO:188) |
| 71 | -EIDHIIPRS-LTGRTKKTVFNSE-ANLIYCSSKGN | (SEQ ID NO:189) |
| 73 | -EIDHIIPRS-LTLKKSESIYNSE-VNLIFVSAQGN | (SEQ ID NO:190) |

Fig. 5C

```
72        -EIDHIYPRS-LSKKHFGVIPNSE-VNLIYCSSQGN    (SEQ ID NO:191)
74        -EIDHILPRS-HTLKIYGTVFNPE-GNLIYVHQKCN    (SEQ ID NO:192)
75        -ELDHIIPRS-HKKY---GTLNDE-ANLICVTRGDN    (SEQ ID NO:193)
34        -ELEHIVPHS-FRQS------NAL-SSLVLTWPGVN    (SEQ ID NO:194)
                *  *
```

Fig. 6A

Alignment of the HNH-like Domains disclosed in Chylinski et al. (excluding sequence outliers). (CLUSTAL format alignment by MAFFT (v7.058b))

```
1     YDIDHIYPRS-LTKDDS-FDNLVLCERTAN    (SEQ ID NO:196)
2     -DIDHIYPRSKVIKDDS-FDNLVLVLKNEN    (SEQ ID NO:197)
3     -DRDHIYPQS-KIKDDS-IDNLVLVNKTYN    (SEQ ID NO:198)
4     -DIDHIYPRS-KIKDDS-ITNRVLVEKDIN    (SEQ ID NO:195)
6     -DIDHIYPQS-KIKDDS-ISNRVLVCSSCN    (SEQ ID NO:124)
5     -DIDHIYPQS-KTMDDS-LNNRVLVKKNYN    (SEQ ID NO:125)
7     -DQDHIYPKS-KIYDDS-LENPVLVKKNLN    (SEQ ID NO:126)
8     -QIDHIVPQS-LVKDDS-FDNRVLVVPSEN    (SEQ ID NO:127)
9     -DIDHIIPQA-PIKDNS-IDNRVLTSSKEN    (SEQ ID NO:128)
12    -DIDHIIPQA-FLKDNS-IDNKVLVSSASN    (SEQ ID NO:129)
16    -DIDHIIPQA-YTKDNS-LDNRVLVSNITN    (SEQ ID NO:130)
11    -DIDHIVPQS-PITDNS-IDNLVLTSSAGN    (SEQ ID NO:131)
10    -DVDHIVPQS-PLKDDS-IDNKVLTRSDKN    (SEQ ID NO:132)
14    -NIDHIYPQS-MVKDDS-LDNKVLVQSEIN    (SEQ ID NO:133)
18    -DIDHILPQS-LIKDDS-LDNRVLVNATIN    (SEQ ID NO:134)
19    -DIDHILPQS-PIKDDS-LENRVLVKKAVN    (SEQ ID NO:135)
13    -EVDHIPPRS-PIKDDS-IDNKVLVIKKMN    (SEQ ID NO:136)
15    -EVDHIIPRS-YIKDDS-FENKVLVYREEN    (SEQ ID NO:137)
17    -DIDHIIPQA-VTQNDS-IDNRVLVARAEN    (SEQ ID NO:138)
21    -DIDHIVPRS-ISFDDS-FSNLVIVNKLDN    (SEQ ID NO:166)
22    -EIDHIIPYS-ISFLDS-SSNKLLVLAESN    (SEQ ID NO:139)
24    -EIDHIIPYS-LCFDDS-SANKVLVHKQSN    (SEQ ID NO:140)
28    -EIDHIIPIS-ISLDDS-INNKVLVLSKAN    (SEQ ID NO:148)
30    -EVDHIIPIS-ISLDDS-ITNKVLVTHREN    (SEQ ID NO:149)
27    -EVDHILPLS-ITFDDS-LANKVLVYATAN    (SEQ ID NO:151)
26    -EIDHIIPRS-ISFDDA-RSNKVLVYRSEN    (SEQ ID NO:152)
29    -EVDHIIPRS-VSFDNS-YHNKVLVKQSEN    (SEQ ID NO:153)
31    -EVDHIIPYS-ISWDDS-YTNKVLTSAKCN    (SEQ ID NO:162)
32    -DIDHIIPYS-RSMDDS-YSNKVLVLSGEN    (SEQ ID NO:141)
23    -EIEHIIPYS-MSYDNS-QANKILTEKAEN    (SEQ ID NO:167)
33    -EVDHIVPYS-LILDNT-INNKALVYASEN    (SEQ ID NO:170)
25    -EIDHVIPYS-KSADDS-WFNKLLVKKSTN    (SEQ ID NO:168)
49    -EMDHILPYS-RSLDNG-WHNRVLVHGKDN    (SEQ ID NO:169)
42    -EIEHVIPQS-LYFDDS-FSNKVICEAEVN    (SEQ ID NO:171)
43    -DIEHIIPQA-RLFDDS-FSNKTLEARSVN    (SEQ ID NO:172)
```

Fig. 6B

```
44    -EIEHIVPKA-RVFDDS-FSNKTLTFHRIN    (SEQ ID NO:173)
20    -DKDHIIPQS-MKKDDSIINNLVLVNKNAN    (SEQ ID NO:174)
45    -QVDHILPWS-RFGDDS-YLNKTLCTARSN    (SEQ ID NO:163)
50    -DIDHVIPLA-RGGRDS-LDNMVLCQSDAN    (SEQ ID NO:180)
46    -DMEHTIPKS-ISFDNS-DQNLTLCESYYN    (SEQ ID NO:177)
47    -DIEHTIPRS-AGGDST-KMNLTLCSSRFN    (SEQ ID NO:178)
48    -DIEHTIPRS-ISQDNS-QMNKTLCSLKFN    (SEQ ID NO:179)
39    -DIEHLFPIA-ESEDNG-RNNLVISHSACN    (SEQ ID NO:181)
41    -DVDHIFPRD-DTADNS-YGNKVVAHRQCN    (SEQ ID NO:182)
40    -DIEHIVPQS-LGGLST-DYNTIVTLKSVN    (SEQ ID NO:183)
35    -ELDHIVPRT-DGGSNR-HENLAITCGACN    (SEQ ID NO:184)
36    -EMDHIVPRKGVGSTNT-RTNFAAVCAECN    (SEQ ID NO:185)
37    -EMDHIVPRKGVGSTNT-RVNLAAACAACN    (SEQ ID NO:186)
38    -EMDHIVPRAGQGSTNT-RENLVAVCHRCN    (SEQ ID NO:187)
34    -ELEHIVPHS-FRQSNA-LSSLVLTWPGVN    (SEQ ID NO:194)
```

Fig. 17A (con't.)

Fig. 17A (con't.)

Fig. 17A (con't.)

Fig. 17A (con't.)

Fig. 17A (con't.)

Fig. 17A (con't.)

Fig. 17A (con't.)

Fig. 17A (con't.)

Fig. 17B

Fig. 17B (con't.)

Fig. 17B (con't.)

Fig. 17B (con't.)

Fig. 17B (con't.)

Fig. 17B (con't.)

Fig. 17B (con't.)

Fig. 17B (con't.)

Fig. 17B (con't.)

Fig. 17C

Fig. 17C (con't.)

Fig. 17C (con't.)

Fig. 17C (con't.)

Fig. 17C (con't.)

Fig. 17C (con't.)

Fig. 17C (con't.)

cctcttcgctattacgccaggctgca
ggagaagcgataatgcggtccgacgt 5,460    5,470    5,480

Fig. 17D

Fig. 17D (con't.)

Fig. 17D (con't.)

Fig. 17D (con't.)

Fig. 17D (con't.)

Fig. 17E

Fig. 17E (con't.)

Fig. 17E (con't.)

Fig. 17E (con't.)

Fig. 17E (con't.)

Fig. 17E (con't.)

Fig. 17E (con't.)

Fig. 17E (con't.)

Fig. 17E (con't.)

Fig. 17F

Fig. 17F (con't.)

Fig. 17F (con't.)

Fig. 17F (con't.)

Fig. 17F (con't.)

Fig. 17F (con't.)

Fig. 17F (con't.)

Fig. 17F (con't.)

Fig. 17F (con't.)

Fig. 17G

Fig. 17G (con't.)

Fig. 17G (con't.)

Fig. 17G (con't.)

Fig. 17G (con't.)

Fig. 17G (con't.)

Fig. 17G (con't.)

Fig. 17G (con't.)

Fig. 17G (con't.)

Fig. 17H

Fig. 17H (con't.)

Fig. 17H (con't.)

Fig. 17H (con't.)

Fig. 17H (con't.)

Fig. 17H (con't.)

Fig. 17H (con't.)

Fig. 17H (con't.)

Fig. 17H (con't.)

Fig. 17I

Fig. 17I (con't.)

Fig. 171 (con't.)

```
GATGCTTTTCTGTGACTGGTGAGTACTCAACCAAGTCATTCTGAGAATAGTGTATGCGGCGACCGAGTTGCTCTTGCCCGGCGTCAATACGGGATAATACCGCGCCA
CTACGAAAAGACACTGACCACTCATGAGTTGGTTCAGTAAGACTCTTATCACATACGCCGCTGGCTCAACGAGAACGGGCCGCAGTTATGCCCTATTATGGCGCGGT
```
AmpR 1,820　　1,840　　1,860　　1,880　　1,900　　1,920

```
CATAGCAGAACTTTAAAAGTGCTCATCATTGGAAAACGTTCTTCGGGGCGAAAACTCTCAAGGATCTTACCGCTGTTGAGATCCAGTTCGATGTAACCCACTCGTGC
GTATCGTCTTGAAATTTTCACGAGTAGTAACCTTTTGCAAGAAGCCCCGCTTTTGAGAGTTCCTAGAATGGCGACAACTCTAGGTCAAGCTACATTGGGTGAGCACG
```
AmpR 1,940　　1,960　　1,980　　2,000　　2,020

```
ACCCAACTGATCTTCAGCATCTTTTACTTTCACCAGCGTTTCTGGGTGAGCAAAAACAGGAAGGCAAAATGCCGCAAAAAAGGGAATAAGGGCGACACGGAAATGTT
TGGGTTGACTAGAAGTCGTAGAAAATGAAAGTGGTCGCAAAGACCCACTCGTTTTTGTCCTTCCGTTTTACGGCGTTTTTCCCTTATTCCCGCTGTGCCTTTACAA
```
AmpR 2,040　　2,060　　2,080　　2,100　　2,120　　2,140

```
GAATACTCATACTCTTCCTTTTTCAATATTATTGAAGCATTTATCAGGGTTATTGTCTCATGAGCGGATACATATTTGAATGTATTTAGAAAAATAAACAAATAGGG
CTTATGAGTATGAGAAGGAAAAAGTTATAATAACTTCGTAAATAGTCCCAATAACAGAGTACTCGCCTATGTATAAACTTACATAAATCTTTTTATTTGTTTATCCC
```
AmpR 2,160　　2,180　　2,200　　2,220　　2,240

```
GTTCCGCGCACATTTCCCCGAAAAGTGCCACCT
CAAGGCGCGTGTAAAGGGGCTTTTCACGGTGGA
```
2,250　　2,260　　2,270　　2,280

Fig. 17J (con't.)

Fig. 17J (con't.)

Fig. 17J (con't.)

Fig. 17J (con't.)

Fig. 17J (con't.)

Fig. 17J (con't.)

Fig. 17J (con't.)

Fig. 17J (con't.)

Fig. 17K

Fig. 17K (con't.)

Fig. 17K (con't.)

```
CTGCACGACAGGTCTGCCAGCTTACATTTACCCAAACTGTCCATTACCGGAACCTATGATCTGAAGAGCGTCCTGGGTCAACTGGGCATCACTAAGGTGTTCAGCAA
GACGTGCTGTCCAGACGGTCGAATGTAAATGGGTTTGACAGGTAATGGCCTTGGATACTAGACTTCTCGCAGGACCCAGTTGACCCGTAGTGATTCCACAAGTCGTT
```
```
                                    2kb homology arm
     1,820        1,840         1,860         1,880         1,700
```
```
TGGGGCTGACCTCTCCGGGGTCACAGAGGAGGCACCCCTGAAACTCTCCAAGGTGAGATCACCCTGACGACCTTGTTGCACCCTGGTATCTGTCGGAAGAATGTGT
ACCCCGACTGGAGAGGCCCCAGTGTCTCCTCCGTGGGGACTTTGAGAGGTTCCACTCTAGTGGGACTGCTGGAACAACGTGGGACCATAGACAGCCCTTCTTACACA
```
```
                                    2kb homology arm
     1,720        1,740         1,760         1,780         1,800
```
```
GGGGCTGCAGCTCTGTCCTGAGGCTGAGGAAGGGGGCGAGGGAAACAAATGAAGACCCAGGCTGAGCTCCTGAAGATGCCCGTGACTCACTGACACGGGACGTGGT
CCCCGACGTCGAGACAGGACTCCGACTCCTTCCCCCGCTCCCTTTGTTTACTTCTGGGTCCGACTCGAGGACTTCTACGGGCACTGAGTGACTGTGCCCTGCACCA
```
```
                                    2kb homology arm
     1,820        1,840         1,860         1,880         1,900         1,920
```
```
CAAACAGCAAAGCCAGGCAGGGACTGCTCTGCAGCTGGCACTTTCCGGGGCCTCCCTTGAGGTTGTGTCACTGACCCTGCATTTCAACTTTGCCCAAGACCTTCTAG
GTTTGTCGTTTCGGTCCGTCCCCTGACGAGACGTCGACCGTGAAAGCCCCGGAGGGAACTCCAACACAGTGACTGGGACGTAAAGTTGAAACGGGTTCTGGAAGATC
```
```
                                    2kb homology arm
     1,940        1,960         1,980         2,000         2,020
```
```
ACATTGGGCCTTGATTTATCCACACTGACACAGAAAGGTTTGGGCTAAGTTGTTTCAAAGGAATTTCTGACTGCTTCGATCTGTGAGATTTGGTGTCTGAATTAATG
TGTAACCCGGAACTAAATAGGTGTGACTGTGTCTTTCCAAACCCGATTCAACAAAGTTTCCTTAAAGACTGACGAAGCTAGACACTCTAAACCACAGACTTAATTAC
```
```
                                    2kb homology arm
     2,040        2,060         2,080         2,100         2,120         2,140
```
```
AATGATTTCAGCTAACGATGACACTTATTTTGGAAAAACTAAAGGCGACCAATGAACAACTGCAGTCCCATGAATGGCTGCATTATCTTGGGGTCTGGGCACTGTGAA
TTACTAAAGTCGATTGCTACTGTGAATAAAACCTTTTGATTTCCGCTGGTTACTTGTTGACGTCAGGGTACTTACCGACGTAATAGAACCCCAGACCCGTGACACTT
```
```
                                    2kb homology arm
     2,160        2,180         2,200         2,220         2,240
```
```
GGTCACTGGCAGGGTCCGTGTCCTCAAGGAGCTTCAAGCCGTGTACTAGAAAGGAGAGCGCCCTGGAGGCAGACGTGGAGTGACGATGCTCTTCCCTGTTCTGAGTT
CCAGTGACCGTCCCAGGCACAGGAGTTCCTCGAAGTTCGGCACATGATCTTTCCTCTCGCGGGACCTCCGTCTGCACCTCACTGCTACGAGAAGGGACAAGACTCAA
```
```
                                    2kb homology arm
     2,260        2,280         2,300         2,320         2,340
```

Fig. 17K (con't.)

Fig. 17K (con't.)

Fig. 17K (con't.)

Fig. 17K (con't.)

Fig. 17K (con't.)

Fig. 17K (con't.)

Fig. 17L

Fig. 17L (con't.)

Fig. 17L (con't.)

Fig. 17L (con't.)

Fig. 17L (con't.)

Fig. 17L (con't.)

Fig. 17L (con't.)

Fig. 17L (con't.)

Fig. 17M

Fig. 17M (con't.)

Fig. 17M (con't.)

Fig. 17M (con't.)

Fig. 17M (con't.)

Fig. 17M (con't.)

Fig. 17M (con't.)

Fig. 17M (con't.)

Fig. 22
PBS
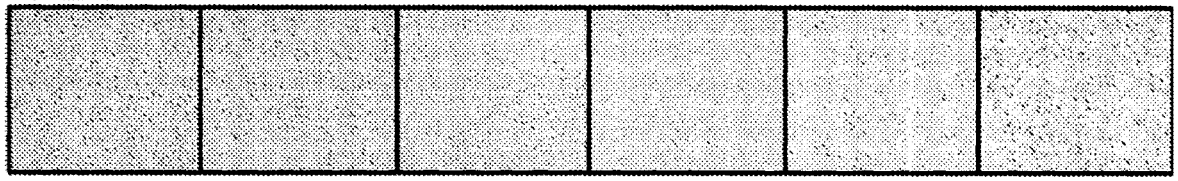
AAV8-SS112
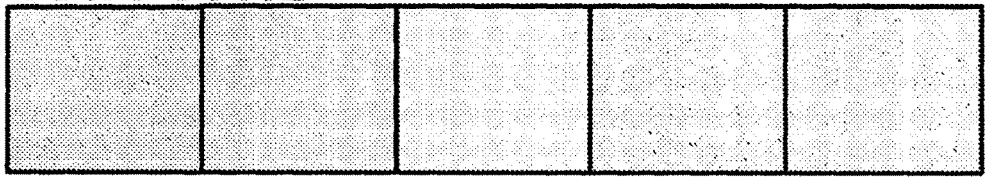
AAV8-SS113
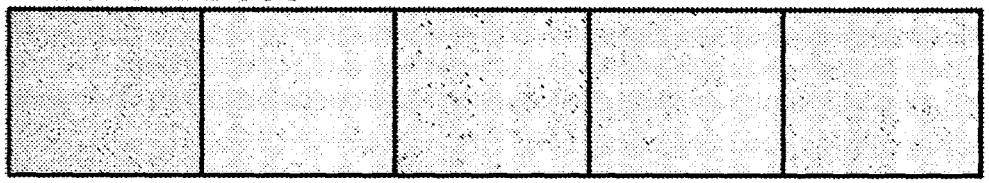
AAV8-SS114
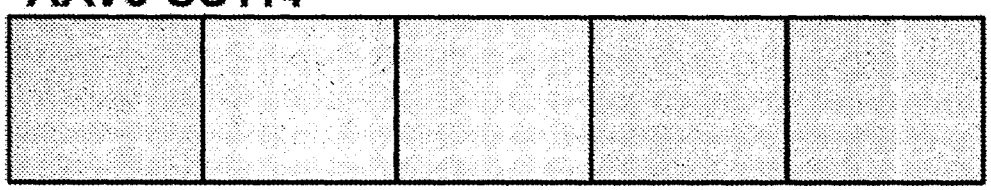
AAV8-SS115
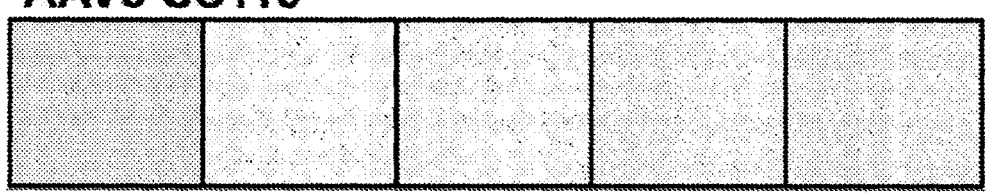

PBS

SYSTEMS AND METHODS FOR TREATING ALPHA 1-ANTITRYPSIN (A1AT) DEFICIENCY

REFERENCE TO RELATED APPLICATIONS

The present application claims the benefit of U.S. Provisional Appl. No. 62/313,688, filed Mar. 25, 2016, and U.S. Provisional Appl. No. 62/452,333, filed Jan. 30, 2017. The contents of both of these applications are incorporated by reference herein in their entirety, including drawings.

SEQUENCE LISTING

This application contains a Sequence Listing, which was submitted in ASCII format via EFS-Web, and is hereby incorporated by reference in its entirety. The ASCII copy, created on Mar. 24, 2017, is named 8007WO00_Sequence_Listing.txt and is 611 KB in size.

FIELD OF THE INVENTION

The invention relates to CRISPR/RNA-guided nuclease related methods and components for editing of a target nucleic acid sequence, or modulating expression of a target nucleic acid sequence, and applications thereof in connection with alpha 1-antitrypsin (A1AT) deficiency.

BACKGROUND

Alpha-1 antitrypsin (A1AT) deficiency (AATD) is a genetic disease caused by defects in the SERPINA1 gene. Severe A1AT deficiency is associated with lung and liver disease. Lung disease associated with A1AT deficiency is currently treated with intravenous administration of human-derived replacement A1AT protein, but in addition to being costly and requiring frequent injections over a subject's entire lifetime, this approach is only partially effective. A1AT-deficient subjects with hepatocellular carcinoma are currently treated with chemotherapy and surgery, but there is no satisfactory approach for preventing the potentially deadly liver manifestations of A1AT deficiency. Thus, there is a need for improved methods and compositions for treating A1AT deficiency, including both liver and lung manifestations thereof.

SUMMARY OF THE INVENTION

Methods and compositions discussed herein, provide for treating or delaying the onset or progression of diseases of the liver, lung, monocytes, or macrophages, e.g., disorders that affect hepatocytes, e.g., disorders that affect lung epithelium and/or lung parenchyma, e.g., disorders that affect macrophages, or e.g., disorders that affect monocytes.

Methods and compositions discussed herein, provide for treating or delaying the onset or progression of alpha-1 antitrypsin deficiency (A1AT deficiency). While much of the disclosure herein is presented in the context of the mutation in the SERPINA1 gene that gives rise to an A1AT mutant protein having a mutation at E342, E264, or both, e.g., an A1AT mutant protein having an E342K substitution, an E264V substitution, or both, the methods and compositions herein are broadly applicable to any mutation, e.g., a point mutation or a deletion, in the SERPINA1 gene that gives rise to A1AT deficiency.

In one aspect, methods and compositions discussed herein, provide for the correction of the underlying genetic cause of A1AT deficiency, e.g., the correction of a mutation at a target position in the SERPINA1 gene resulting in correction of a mutation of an A1AT protein at amino acid position 342, 264, or both (e.g., an E342K substitution, an E264V substitution, or both). As used herein, "A1AT protein" and "AAT protein" can be used interchangeably.

Mutations in the SERPINA1 gene have been shown to cause A1AT deficiency. Mutations leading to A1AT deficiency can be described based on their target positions in the SERPINA1 gene that encode the mutated amino acids. In an embodiment, an A1AT target position comprises or consists of one or more nucleotide mutations in the SERPINA1 gene, which results in expression of an A1AT mutant protein comprising an amino acid mutation at E342 (e.g., residue 366 in SEQ ID NO:252). In certain embodiments, the A1AT target position comprises or consists of a nucleotide mutation at position c.1024 in the SERPINA1 gene (e.g., NT 13990 in SEQ ID NO:2231), which results in expression of an A1AT mutant protein comprising an amino acid mutation at E342. In certain embodiments, the A1AT target position comprises or consists of the nucleotide mutation c.1024G>A in the SERPINA1 gene, which results in the expression of an A1AT mutant protein comprising the amino acid mutation E342K. In certain embodiments, the A1AT target position comprises or consists of a nucleotide mutation in the SERPINA1 gene, which results in expression of an A1AT mutant protein comprising an amino acid mutation at E264 at residue 288 in SEQ ID NO:252. In certain embodiments, the A1AT target position comprises or consists of a nucleotide mutation at position c.791 in the SERPINA1 gene (e.g., NT 11675 in SEQ ID NO:2231), which results in expression of an A1AT mutant protein comprising an amino acid mutation at E264. In certain embodiments, the A1AT target position comprises or consists of a nucleotide mutation c.791A>T in the SERPINA1 gene, which results in the expression of an A1AT mutant protein comprising the amino acid mutation E264V. In an embodiment, the A1AT target position comprises or consists of nucleotide mutations at positions c.1024 and c.791 in the SERPINA1 gene, which results in expression of an A1AT mutant protein comprising amino acid mutations at E342 and E264. In an embodiment, the A1AT target position comprises or consists of nucleotide mutations c.1024G>A and c.791A>T in the SERPINA1 gene, which results in expression of an A1AT mutant protein comprising the amino acid mutations E342K and E264V. In certain embodiments, the A1AT target position comprising or consisting of a nucleotide mutation at position c.1024 in the SERPINA1 gene (e.g., NT 13990 in SEQ ID NO:2231) is an A1AT target point position. In certain embodiments, the A1AT target position comprising or consisting of a nucleotide mutation at position c.791 in the SERPINA1 gene (e.g., NT 11675 in SEQ ID NO:2231) is an A1AT target point position.

While not wishing to be bound by theory, it is believed that, in an embodiment, a mutation at an A1AT target point position in the SERPINA1 gene is corrected, e.g., by homology directed repair (HDR), as described herein.

In one aspect, methods and compositions discussed herein may be used to alter the SERPINA1 gene to treat or prevent A1AT deficiency, by targeting the SERPINA1 gene, e.g., coding or non-coding regions of the SERPINA1 gene. In an embodiment, altering the SERPINA1 gene refers to reducing or eliminating (1) SERPINA1 gene expression, (2) SERPINA1 protein function, or (3) the level of SERPINA1 protein.

In an embodiment, the coding region (e.g., an early coding region) of the SERPINA1 gene is targeted for alteration. In an embodiment, a non-coding sequence (e.g., a promoter region, an enhancer region, an intron, 5'UTR, 3'UTR, or polyadenylation signal) is targeted for alteration. In an embodiment, Exon II is targeted for alteration. In an embodiment, the start codon in Exon II is targeted for alteration. In an embodiment, Exon V is targeted for alteration. In an embodiment, Exon IV is targeted for alteration.

In an embodiment, the method provides an alteration that comprises disrupting the SERPINA1 gene by the insertion or deletion of one or more nucleotides mediated by an RNA-guided nuclease (e.g., Cas9 (e.g., enzymatically active Cas9 (eaCas9), e.g., Cas9 nuclease or Cas9 nickase) as described below). This type of alteration is also referred to as "knocking out" the SERPINA1 gene.

In an embodiment, the methods and compositions discussed herein may be used to alter the SERPINA1 gene to treat or prevent A1AT deficiency by knocking out one or both alleles of the SERPINA1 gene. In an embodiment, the coding region (e.g., an early coding region) of the SERPINA1 gene, is targeted to alter the gene. In an embodiment, a non-coding region of the SERPINA1 gene (e.g., an enhancer region, a promoter region, an intron, 5' UTR, 3'UTR, polyadenylation signal) is targeted to alter the gene. In an embodiment, Exon II is targeted for alteration. In an embodiment, the start codon in Exon II is targeted for alteration. In an embodiment, Exon V is targeted for alteration. In an embodiment, Exon IV is targeted for alteration. In an embodiment, the method provides an alteration that comprises an insertion or deletion of one or more nucleotides. As described herein, in an embodiment, a targeted knockout approach is mediated by non-homologous end joining (NHEJ) using a CRISPR/RNA-guided nuclease system comprising an enzymatically active RNA-guided nuclease (e.g., enzymatically active Cas9 (eaCas9)). In an embodiment, a targeted knockout approach alters the SERPINA1 gene. In an embodiment, a targeted knockout approach reduces or eliminates expression of functional SERPINA1 gene product. In an embodiment, targeting affects one or both alleles of the SERPINA1 gene.

While not wishing to be bound by theory, it is believed that, in an embodiment, the A1AT target knockout position is altered, e.g., disrupted by insertion or deletion (e.g., indel) of one or more nucleotides, by NHEJ-mediated alteration, as described herein.

In an embodiment, methods and compositions discussed herein, provide for altering (e.g., knocking out) the SERPINA1 gene. In an embodiment, knocking out the SERPINA1 gene refers to (i) insertion or deletion (e.g., NHEJ-mediated insertion or deletion (e.g., indel)) of one or more nucleotides in close proximity to or within the early coding region of the SERPINA1 gene, or (2) deletion (e.g., NHEJ-mediated deletion) of a genomic sequence including at least a portion of the SERPINA1 gene.

In an embodiment, the A1AT target knockout position is altered by genome editing using the CRISPR/RNA-guided nuclease (e.g., Cas9) system. The A1AT target knockout position may be targeted by cleaving with either a single nuclease or dual nickases, e.g., to induce insertion or deletion (e.g., NHEJ-mediated insertion or deletion) of one or more nucleotides in close proximity to or within the early coding region of the A1AT target knockout position of the SERPINA1 gene.

In an embodiment, the methods and compositions described herein introduce one or more breaks in close proximity to or within the early coding region in at least one allele of the SERPINA1 gene. In an embodiment, a single strand break is introduced in close proximity to or within the early coding region in at least one allele of the SERPINA1 gene. In an embodiment, the single strand break will be accompanied by an additional single strand break, positioned by a second gRNA molecule.

In an embodiment, a double strand break is introduced in close proximity to or within the early coding region in at least one allele of the SERPINA1 gene. In an embodiment, a double strand break will be accompanied by an additional single strand break positioned by a second gRNA molecule. In an embodiment, a double strand break will be accompanied by two additional single strand breaks positioned by a second gRNA molecule and a third gRNA molecule.

In an embodiment, a pair of single strand breaks is introduced in close proximity to or within the early coding region in at least one allele of the SERPINA1 gene. In an embodiment, the pair of single strand breaks will be accompanied by an additional double strand break, positioned by a third gRNA molecule. In an embodiment, the pair of single strand breaks will be accompanied by an additional pair of single strand breaks positioned by a third gRNA molecule and a fourth gRNA molecule.

In an embodiment, the methods and compositions discussed herein may be used to alter the SERPINA1 gene to treat or prevent A1AT deficiency by knocking in a SERPINA1 sequence. In an embodiment, altering the SERPINA1 gene refers to increasing or restoring (1) SERPINA1 gene expression, (2) SERPINA1 protein function, or (3) the level of SERPINA1 protein.

While not wishing to be bound by theory, it is believed that, in an embodiment, a sequence is inserted, e.g., by homology directed repair (HDR), as described herein.

Exemplary A1AT target knockin positions include, but are not limited to, a sequence between the promoter region and translation state codon, into which, e.g., a sequence that codes for Exons II-V of the SERPINA1 gene can be introduced; a sequence at or near the – translation start codon, into which, e.g., a sequence that codes for Exons II-V of the SERPINA1 gene can be introduced; a sequence between Exon IC and Exon II, into which, e.g., a sequence that codes for Exons II-V of the SERPINA1 gene can be introduced; a sequence between Exons II and III, into which a sequence that codes for Exons III-V of the SERPINA1 gene can be introduced.

In an embodiment, a target knockin position includes an intronic sequence between a first and a second exon, and a sequence encoding the second exon through the final exon (e.g., Exons II-V), is introduced, resulting in a sequence that is free of the S mutation, E264V, or the Z mutation, E342K. In an embodiment, a target knockin position is a position which is upstream of a mutation, or upstream of an exon having a mutation, and an insertion (e.g., HDR-mediated insertion) results in a sequence that is free of the mutation. In an embodiment, the target knockin position is in an intronic sequence: between Exon 1A and Exon 1B; between Exon 1B and Exon 1C; between Exon 1C and Exon II; between Exon II and Exon III; between Exon III and Exon IV; or between Exon IV and Exon V. In an embodiment, the resulting sequence comprises subject sequence upstream from the target knockin position and a newly introduced sequence downstream from the target knockin position, which taken together, encode a protein having wild-type activity. In an embodiment, the point of insertion is 3' to a splice donor site and 5' from a splice acceptor site. In an embodiment, a sequence encoding Exons II-V is inserted under control of a promoter, e.g., at or near the translation start codon. In an embodiment, the promoter is an endogenous promoter. In an embodiment, the promoter is an exogenous promoter. In an embodiment, the promoter is a synthetic promoter. In an embodiment, the sequence introduced can exclude introns, e.g., a sequence encoding exons, but without introns, is inserted.

In an embodiment, the methods and compositions discussed herein may be used to alter the SERPINA1 gene to treat or prevent A1AT deficiency by knocking down one or both alleles of the SERPINA1 gene. In one embodiment, the coding region of the SERPINA1 gene, is targeted to alter the gene. In another embodiment, a non-coding region (e.g., an enhancer region, a promoter region, an intron, 5' UTR, 3' UTR, polyadenylation signal) of the SERPINA1 gene is targeted to alter the gene. In an embodiment, the promoter region of the SERPINA1 gene is targeted to knock down the expression of the SERPINA1 gene. A targeted knockdown approach alters, e.g., reduces or eliminates the expression of the SERPINA1 gene.

In one aspect, disclosed herein is a gRNA molecule, e.g., an isolated or non-naturally occurring gRNA molecule, comprising a targeting domain which is complementary or partially complementary with a target domain from the SERPINA1 gene.

When two or more gRNAs are used to position two or more cleavage events, e.g., double strand or single strand breaks, in a target nucleic acid, it is contemplated that the two or more cleavage events may be made by the same or different RNA-guided nucleases (e.g., Cas9 proteins (e.g., enzymatically active Cas9 (eaCas9), e.g., Cas9 nuclease or Cas9 nickase) as described below). For example, when two gRNAs are used to position two double strand breaks, a single Cas9 nuclease may be used to create both double strand breaks. When two or more gRNAs are used to position two or more single stranded breaks (single strand breaks), a single Cas9 nickase may be used to create the two or more single strand breaks. When two or more gRNAs are used to position at least one double strand break and at least one single strand break, two Cas9 proteins may be used, e.g., one Cas9 nuclease and one Cas9 nickase. It is contemplated that when two or more Cas9 proteins are used that the two or more Cas9 proteins may be delivered sequentially to control specificity of a double strand versus a single strand break at the desired position in the target nucleic acid.

In an embodiment, the targeting domain of the first gRNA molecule and the targeting domain of the second gRNA molecule hybridize to the target domain through complementary base pairing to opposite strands of the target nucleic acid molecule. In an embodiment, the gRNA molecule and the second gRNA molecule are configured such that the PAMs are oriented outward.

In an embodiment, the targeting domain of a gRNA molecule is configured to avoid unwanted target chromosome elements, such as repeat elements, e.g., an Alu repeat, or the endogenous splice sites, in the target domain. The gRNA molecule may be a first, second, third and/or fourth gRNA molecule.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

In certain embodiments, the targeting domain of a gRNA molecule comprises a sequence that is the same as, or differs by no more than 1, 2, 3, 4, or 5 nucleotides from, a targeting domain sequence described herein, e.g., a targeting domain sequence set forth in any of SEQ ID NOs:253-2192. In certain of these embodiments, the targeting domain comprises a sequence that is the same as a targeting domain sequence set forth in any of SEQ ID NOs:253-2192.

In certain embodiments, a point mutation in the SERPINA1 gene, e.g., resulting in expression of a A1AT mutant protein comprising an amino acid mutation at E342, e.g., E342K, is targeted, e.g., for correction. In certain embodiments, the targeting domain of a gRNA molecule comprises a sequence that is the same as, or differs by no more than 1, 2, 3, 4, or 5 nucleotides from, a targeting domain sequence set forth in Table 6. In certain of these embodiments, the targeting domain comprises a sequence set forth in Table 6.

In certain embodiments, Exon II in the SERPINA1 gene, e.g., at or near the start codon, is targeted, e.g., for knockout or knockin. In certain embodiments, the targeting domain of a gRNA molecule comprises a sequence that is the same as, or differs by no more than 1, 2, 3, 4, or 5 nucleotides from, a targeting domain sequence set forth in Table 9. In certain of these embodiments, the targeting domain comprises a sequence set forth in Table 9.

In certain embodiments, a coding sequence in the SERPINA1 gene, e.g., Exon V or IV, is targeted, e.g., for knockout. In certain embodiments, the targeting domain of a gRNA molecule comprises a sequence that is the same as, or differs by no more than 1, 2, 3, 4, or 5 nucleotides from, a targeting domain sequence set forth in Tables 7 or 8. In certain of these embodiments, the targeting domain comprises a sequence set forth in Table 7 or 8.

In certain embodiments, a targeting domain that is fully or partially complementary to a sequence in or near the SERPINA1 gene is 16 nucleotides or more in length. For example, the targeting domain may be 16, 17, 18, 19, 20, 21, 22, 23, 24, 25, or 26 nucleotides in length.

In certain embodiments, the gRNA, e.g., a gRNA comprising a targeting domain fully or partially is complementary with a sequence in or near the SERPINA1 gene is a modular gRNA. In other embodiments, the gRNA is a unimolecular or chimeric gRNA.

A gRNA as described herein may comprise from 5' to 3': a targeting domain (comprising a "core domain" and, optionally, a "secondary domain"); a first complementarity domain; a linking domain; a second complementarity domain; a proximal domain; and a tail domain. In an embodiment, the proximal domain and tail domain are taken together as a single domain.

In an embodiment, a gRNA comprises a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 25 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

A cleavage event, e.g., a double strand or single strand break, is generated by an RNA-guided nuclease (e.g., Cas9 molecule). The Cas9 molecule may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule).

In an embodiment, the eaCas9 molecule catalyzes a double strand break.

In an embodiment, the eaCas9 molecule comprises HNH-like domain cleavage activity but has no, or no significant, N-terminal RuvC-like domain cleavage activity. In this case, the eaCas9 molecule is an HNH-like domain nickase, e.g., the eaCas9 molecule comprises a mutation at D10, e.g., D10A. In another embodiment, the eaCas9 molecule comprises N-terminal RuvC-like domain cleavage activity but has no, or no significant, HNH-like domain cleavage activity. In an embodiment, the eaCas9 molecule is an N-terminal RuvC-like domain nickase, e.g., the eaCas9 molecule comprises a mutation at H840, e.g., H840A. In an embodiment, the eaCas9 molecule is an N-terminal RuvC-like domain nickase, e.g., the eaCas9 molecule comprises a mutation at N863, e.g., N863A. In an embodiment, the eaCas9 molecule is an N-terminal RuvC-like domain nickase, e.g., the eaCas9 molecule comprises a mutation at N580, e.g., N580A.

In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

In another aspect, disclosed herein is a nucleic acid, e.g., an isolated or non-naturally occurring nucleic acid, e.g., DNA, that comprises (a) a sequence that encodes a gRNA molecule comprising a targeting domain that is complementary with a target domain, e.g., with an A1AT target position, in the SERPINA1 gene as disclosed herein.

In an embodiment, the nucleic acid encodes a gRNA molecule, e.g., a first gRNA molecule, comprising a targeting domain configured to provide a cleavage event, e.g., a double strand break or a single strand break, sufficiently close to an A1AT target position in the SERPINA1 gene to allow alteration, e.g., alteration associated with HDR or NHEJ, of the an A1AT target position in the SERPINA1 gene.

In an embodiment, the nucleic acid encodes a modular gRNA, e.g., one or more nucleic acids encode a modular gRNA. In another embodiment, the nucleic acid encodes a chimeric gRNA. The nucleic acid may encode a gRNA, e.g., the first gRNA molecule, comprising a targeting domain comprising 16 nucleotides or more in length. In one embodiment, the nucleic acid encodes a gRNA, e.g., the first gRNA molecule, comprising a targeting domain that is 16 nucleotides in length. In another embodiment, the nucleic acid encodes a gRNA, e.g., the first gRNA molecule, comprising a targeting domain that is 17 nucleotides in length. In still another embodiment, the nucleic acid encodes a gRNA, e.g., the first gRNA molecule, comprising a targeting domain that is 18 nucleotides in length. In still another embodiment, the nucleic acid encodes a gRNA, e.g., the first gRNA molecule, comprising a targeting domain that is 19 nucleotides in length. In still another embodiment, the nucleic acid encodes a gRNA, e.g., the first gRNA molecule, comprising a targeting domain that is 20 nucleotides in length. In still another embodiment, the nucleic acid encodes a gRNA, e.g., the first gRNA molecule, comprising a targeting domain that is 21 nucleotides in length. In still another embodiment, the nucleic acid encodes a gRNA, e.g., the first gRNA molecule, comprising a targeting domain that is 22 nucleotides in length. In still another embodiment, the nucleic acid encodes a gRNA, e.g., the first gRNA molecule, comprising a targeting domain that is 23 nucleotides in length. In still another embodiment, the nucleic acid encodes a gRNA, e.g., the first gRNA molecule, comprising a targeting domain that is 24 nucleotides in length. In still another embodiment, the nucleic acid encodes a gRNA, e.g., the first gRNA molecule, comprising a targeting domain that is 25 nucleotides in length. In still another embodiment, the nucleic acid encodes a gRNA, e.g., the first gRNA molecule, comprising a targeting domain that is 26 nucleotides in length.

In an embodiment, a nucleic acid encodes a gRNA comprising from 5' to 3': a targeting domain (comprising a "core domain" and, optionally, a "secondary domain"); a first complementarity domain; a linking domain; a second complementarity domain; a proximal domain; and a tail domain. In an embodiment, the proximal domain and tail domain are taken together as a single domain.

In an embodiment, a nucleic acid encodes a gRNA e.g., the first gRNA molecule, comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a gRNA comprising e.g., the first gRNA molecule, a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In an embodiment, a nucleic acid comprises (a) a sequence that encodes a gRNA molecule e.g., the first gRNA molecule, comprising a targeting domain that is complementary with a target domain in the SERPINA1 gene as disclosed herein, and further comprising (b) a sequence that encodes an RNA-guided nuclease (e.g., a Cas9 molecule).

The Cas9 molecule may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule).

A nucleic acid disclosed herein may comprise (a) a sequence that encodes a gRNA molecule comprising a targeting domain that is complementary with a target domain in the SERPINA1 gene as disclosed herein; (b) a sequence that encodes an RNA-guided nuclease (e.g., a Cas9 molecule); and further comprises (c)(i) a sequence that encodes a second gRNA molecule described herein having a targeting domain that is complementary to a second target domain of the SERPINA1 gene, and optionally, (c)(ii) a sequence that encodes a third gRNA molecule described herein having a targeting domain that is complementary to a third target domain of the SERPINA1 gene; and optionally, (c)(iii) a sequence that encodes a fourth gRNA molecule described herein having a targeting domain that is complementary to a fourth target domain of the SERPINA1 gene.

In an embodiment, a nucleic acid encodes a second gRNA molecule comprising a targeting domain configured to provide a cleavage event, e.g., a double strand break or a single strand break, sufficiently close to an A1AT target position in the SERPINA1 gene, to allow alteration, e.g., alteration associated with HDR or NHEJ, of an A1AT target position in the SERPINA1 gene, either alone or in combination with the break positioned by said first gRNA molecule.

In an embodiment, a nucleic acid encodes a third gRNA molecule comprising a targeting domain configured to provide a cleavage event, e.g., a double strand break or a single strand break, sufficiently close to an A1AT target position in the SERPINA1 gene to allow alteration, e.g., alteration associated with HDR or NHEJ, of an A1AT target position in the SERPINA1 gene, either alone or in combination with the break positioned by the first and/or second gRNA molecule.

In an embodiment, a nucleic acid encodes a fourth gRNA molecule comprising a targeting domain configured to provide a cleavage event, e.g., a double strand break or a single strand break, sufficiently close to an A1AT target position in the SERPINA1 gene to allow alteration, e.g., alteration associated with HDR or NHEJ, of an A1AT target position in the SERPINA1 gene, either alone or in combination with the break positioned by the first gRNA molecule, the second gRNA molecule and/or the third gRNA molecule.

In certain embodiments, the nucleic acid encodes a second gRNA molecule. The second gRNA is selected to target the same A1AT target position as the first gRNA molecule. Optionally, the nucleic acid may encode a third gRNA, and further optionally, the nucleic acid may encode a fourth gRNA molecule. The third gRNA molecule and the fourth gRNA molecule are selected to target the same A1AT target position as the first and/or second gRNA molecules.

In certain embodiments, the nucleic acid encodes a second gRNA molecule comprising a targeting domain comprising a sequence that is the same as, or differs by no more than 1, 2, 3, 4, or 5 nucleotides from, a targeting domain sequence set forth in SEQ ID NOs:253-2192. In certain of these embodiments, the nucleic acid encodes a second gRNA molecule comprising a targeting domain set forth in SEQ ID NOs:253-2192. In certain embodiments, when a third or fourth gRNA molecule are present, the third and fourth gRNA molecules may independently comprise a targeting domain comprising a sequence that is the same as, or differs by no more than 1, 2, 3, 4, or 5 nucleotides from, a targeting domain sequence set forth in SEQ ID NOs:253-2192. In a further embodiment, when a third or fourth gRNA molecule are present, the third and fourth gRNA molecules may independently comprise a targeting domain set forth in SEQ ID NOs:253-2192.

In an embodiment, the nucleic acid encodes a second gRNA which is a modular gRNA, e.g., wherein one or more nucleic acid molecules encode a modular gRNA. In another embodiment, the nucleic acid encoding a second gRNA is a chimeric gRNA. In another embodiment, when a nucleic acid encodes a third or fourth gRNA, the third and/or fourth gRNA may be a modular gRNA or a chimeric gRNA. When multiple gRNAs are used, any combination of modular or chimeric gRNAs may be used.

A nucleic acid may encode a second, a third, and/or a fourth gRNA comprising a targeting domain comprising 16 nucleotides or more in length. In an embodiment, the nucleic acid encodes a second gRNA comprising a targeting domain that is 16 nucleotides in length. In another embodiment, the nucleic acid encodes a second gRNA comprising a targeting domain that is 17 nucleotides in length. In still another embodiment, the nucleic acid encodes a second gRNA comprising a targeting domain that is 18 nucleotides in length. In still another embodiment, the nucleic acid encodes a second gRNA comprising a targeting domain that is 19 nucleotides in length. In still another embodiment, the nucleic acid encodes a second gRNA comprising a targeting domain that is 20 nucleotides in length. In still another embodiment, the nucleic acid encodes a second gRNA comprising a targeting domain that is 21 nucleotides in length. In still another embodiment, the nucleic acid encodes a second gRNA comprising a targeting domain that is 22 nucleotides in length. In still another embodiment, the nucleic acid encodes a second gRNA comprising a targeting domain that is 23 nucleotides in length. In still another embodiment, the nucleic acid encodes a second gRNA comprising a targeting domain that is 24 nucleotides in length. In still another embodiment, the nucleic acid encodes a second gRNA comprising a targeting domain that is 25 nucleotides in length. In still another embodiment, the nucleic acid encodes a second gRNA comprising a targeting domain that is 26 nucleotides in length.

In an embodiment, a nucleic acid encodes a second, a third, and/or a fourth gRNA comprising from 5' to 3': a targeting domain (comprising a "core domain" and, optionally, a "secondary domain"); a first complementarity domain; a linking domain; a second complementarity domain; a proximal domain; and a tail domain. In an embodiment, the proximal domain and tail domain are taken together as a single domain.

In an embodiment, a nucleic acid encodes a second, a third, and/or a fourth gRNA comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 35 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In an embodiment, when the SERPINA1 gene is corrected, e.g., by HDR, the nucleic acid encodes (a) a sequence that encodes a gRNA molecule comprising a targeting domain that is complementary with a target domain in the SERPINA1 gene as disclosed herein; (b) a sequence that encodes an RNA-guided nuclease (e.g., a Cas9 molecule); optionally, (c)(i) a sequence that encodes a second gRNA molecule described herein having a targeting domain that is complementary to a second target domain of the SERPINA1 gene, and further optionally, (c)(ii) a sequence that encodes a third gRNA molecule described herein having a targeting domain that is complementary to a third target domain of the SERPINA1 gene; and still further optionally, (c)(iii) a sequence that encodes a fourth gRNA molecule described herein having a targeting domain that is complementary to a fourth target domain of the SERPINA1 gene; and further may comprise (d) a template nucleic acid (in an embodiment where an exogenous template is used).

In an embodiment, when a sequence is inserted, e.g., by HDR, the nucleic acid encodes (a) a sequence that encodes a gRNA molecule comprising a targeting domain that is complementary with a target domain in the SERPINA1 gene as disclosed herein; (b) a sequence that encodes an RNA-guided nuclease (e.g., a Cas9 molecule); optionally, (c)(i) a sequence that encodes a second gRNA molecule described herein having a targeting domain that is complementary to a second target domain of the SERPINA1 gene, and further optionally, (c)(ii) a sequence that encodes a third gRNA molecule described herein having a targeting domain that is complementary to a third target domain of the SERPINA1 gene; and still further optionally, (c)(iii) a sequence that encodes a fourth gRNA molecule described herein having a targeting domain that is complementary to a fourth target domain of the SERPINA1 gene; and further may comprise (d) a template nucleic acid that comprises a full-length or partial coding sequence of SERPINA1 gene, optionally a promoter, and further optionally a polyadenylation signal.

In an embodiment, a mutation in the SERPINA1 gene is corrected, e.g., by HDR, using an exogenously provided template nucleic acid.

In an embodiment, the template nucleic acid is a single stranded nucleic acid. In another embodiment, the template nucleic acid is a double stranded nucleic acid. In an embodiment, the template nucleic acid comprises a nucleotide sequence, e.g., of one or more nucleotides, that will be added to or will template a change in the target nucleic acid. In another embodiment, the template nucleic acid comprises a nucleotide sequence that may be used to modify the target position. In another embodiment, the template nucleic acid comprises a nucleotide sequence, e.g., of one or more nucleotides, that corresponds to wild-type sequence of the target nucleic acid, e.g., of the target position.

In another embodiment, a sequence is inserted to the SERPINA1 gene, e.g., by HDR, without using an exogenously provided template nucleic acid. In an embodiment, the template nucleic acid comprises a sequence including any of Exons II, III, IV, or V. In an embodiment, the template nucleic acid comprises a sequence including Exons II, III, IV, and V. In an embodiment, the template nucleic acid comprises a sequence including Exons III, IV, and V. In an embodiment, the template nucleic acid comprises a promoter sequence. In another embodiment the template nucleic acid does not comprise a promoter sequence. In an embodiment, the template nucleic acid comprises a splice donor or acceptor. In another embodiment, the template nucleic acid includes a polyadenylation signal.

In another embodiment, a mutation in the SERPINA1 gene is corrected, e.g., by HDR, without using an exogenously provided template nucleic acid. While not wishing to be bound by theory, it is believed that an endogenous region of homology can mediate HDR-based correction. In an embodiment, alteration of the target sequence occurs by HDR with an endogenous genomic donor sequence. In an embodiment, the endogenous genomic donor sequence is located on the same chromosome as the target sequence. In another embodiment, the endogenous genomic donor sequence is located on a different chromosome from the target sequence. Mutations in the SERPINA1 gene that can be corrected (e.g., altered) by HDR with an endogenous genomic donor sequence include, e.g., a point mutation in the SERPINA1 gene that results in expression of a mutant A1AT protein comprising an amino acid mutation at E342 or E264, e.g., E342K or E264V.

As described above, a nucleic acid may comprise (a) a sequence encoding a gRNA molecule comprising a targeting domain that is complementary with a target domain in the SERPINA1 gene, and (b) a sequence encoding an RNA-guided nuclease (e.g., a Cas9 molecule).

In an embodiment, (a) and (b) are present on the same nucleic acid molecule, e.g., the same vector, e.g., the same viral vector, e.g., the same adeno-associated virus (AAV) vector. In an embodiment, the nucleic acid molecule is an AAV vector. Exemplary AAV vectors that may be used in any of the described compositions and methods include an AAV1 vector, a modified AAV1 vector, an AAV2 vector, a modified AAV2 vector, an AAV3 vector, a modified AAV3 vector, an AAV4 vector, a modified AAV4 vector, an AAV5 vector, a modified AAV5 vector, an AAV6 vector, a modified AAV6 vector, an AAV7 vector, a modified AAV7 vector, an AAV8 vector, a modified AAV8 vector, an AAV9 vector, a modified AAV9 vector, an AAV.rh10 vector, a modified AAV.rh10 vector, an AAV.rh32/33 vector, a modified AAV.rh32/33 vector, an AAV.rh64 vector, a modified AAV.rh64 vector, and a chimeric AAV vector.

In another embodiment, (a) is present on a first nucleic acid molecule, e.g., a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors.

In another embodiment, the nucleic acid may further comprise (c) a sequence that encodes a second, third and/or fourth gRNA molecule as described herein. In an embodiment, the nucleic acid comprises (a), (b) and (c). Each of (a) and (c) may be present on the same nucleic acid molecule, e.g., the same vector, e.g., the same viral vector, e.g., the same adeno-associated virus (AAV) vector. In an embodiment, the nucleic acid molecule is an AAV vector.

In another embodiment, (a) and (c) are on different vectors. For example, (a) may be present on a first nucleic acid molecule, e.g., a first vector, e.g., a first viral vector, e.g., a first AAV vector; and (c) may be present on a second nucleic acid molecule, e.g., a second vector, e.g., a second vector, e.g., a second AAV vector. In an embodiment, the first and second nucleic acid molecules are AAV vectors.

In another embodiment, each of (a), (b), and (c) are present on the same nucleic acid molecule, e.g., the same vector, e.g., the same viral vector, e.g., an AAV vector. In an embodiment, the nucleic acid molecule is an AAV vector. In an alternate embodiment, one of (a), (b), and (c) is encoded on a first nucleic acid molecule, e.g., a first vector, e.g., a first viral vector, e.g., a first AAV vector; and a second and third of (a), (b), and (c) is encoded on a second nucleic acid molecule, e.g., a second vector, e.g., a second vector, e.g., a second AAV vector. The first and second nucleic acid molecule may be AAV vectors.

In an embodiment, (a) is present on a first nucleic acid molecule, e.g., a first vector, e.g., a first viral vector, a first AAV vector; and (b) and (c) are present on a second nucleic acid molecule, e.g., a second vector, e.g., a second vector, e.g., a second AAV vector. The first and second nucleic acid molecule may be AAV vectors.

In another embodiment, (b) is present on a first nucleic acid molecule, e.g., a first vector, e.g., a first viral vector, e.g., a first AAV vector; and (a) and (c) are present on a second nucleic acid molecule, e.g., a second vector, e.g., a second vector, e.g., a second AAV vector. The first and second nucleic acid molecule may be AAV vectors.

In another embodiment, (c) is present on a first nucleic acid molecule, e.g., a first vector, e.g., a first viral vector, e.g., a first AAV vector; and (b) and (a) are present on a second nucleic acid molecule, e.g., a second vector, e.g., a second vector, e.g., a second AAV vector. The first and second nucleic acid molecule may be AAV vectors.

In another embodiment, each of (a), (b) and (c) are present on different nucleic acid molecules, e.g., different vectors, e.g., different viral vectors, e.g., different AAV vector. For example, (a) may be on a first nucleic acid molecule, (b) on a second nucleic acid molecule, and (c) on a third nucleic acid molecule. The first, second and third nucleic acid molecule may be AAV vectors.

In another embodiment, when a third and/or fourth gRNA molecule are present, each of (a), (b), (c)(i), (c)(ii) and (c)(iii) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii) and (c)(iii) may be present on the different nucleic acid molecules, e.g., different vectors, e.g., the different viral vectors, e.g., different AAV vectors. In further embodiments, each of (a), (b), (c)(i), (c)(ii) and (c)(iii) may be present on more than one nucleic acid molecule, but fewer than five nucleic acid molecules, e.g., AAV vectors.

In another embodiment, when (d) a template nucleic acid is present, each of (a), (b), and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), and (d) may be present on the different nucleic acid molecules, e.g., different vectors, e.g., the different viral vectors, e.g., different AAV vectors. In further embodiments, each of (a), (b), and (d) may be present on more than one nucleic acid molecule, but fewer than three nucleic acid molecules, e.g., AAV vectors.

In another embodiment, when (d) a template nucleic acid is present, each of (a), (b), (c)(i) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i) and (d) may be present on the different nucleic acid molecules, e.g., different vectors, e.g., the different viral vectors, e.g., different AAV vectors. In further embodiments, each of (a), (b), (c)(i) and (d) may be present on more than one nucleic acid molecule, but fewer than four nucleic acid molecules, e.g., AAV vectors.

In another embodiment, when (d) a template nucleic acid is present, each of (a), (b), (c)(i), (c)(ii) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii) and (d) may be present on the different nucleic acid molecules, e.g., different vectors, e.g., the different viral vectors, e.g., different AAV vectors. In further embodiments, each of (a), (b), (c)(i), (c)(ii) and (d) may be present on more than one nucleic acid molecule, but fewer than five nucleic acid molecules, e.g., AAV vectors.

In another embodiment, when (d) a template nucleic acid is present, each of (a), (b), (c)(i), (c)(ii), (c)(iii) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii), (c)(iii) and (d) may be present on the different nucleic acid molecules, e.g., different vectors, e.g., the different viral vectors, e.g., different AAV vectors. In further embodiments, each of (a), (b), (c)(i), (c)(ii), (c)(iii) and (d) may be present on more than one nucleic acid molecule, but fewer than six nucleic acid molecules, e.g., AAV vectors.

The nucleic acids described herein may comprise a promoter operably linked to the sequence that encodes the gRNA molecule of (a), e.g., a promoter described herein. The nucleic acid may further comprise a second promoter operably linked to the sequence that encodes the second, third and/or fourth gRNA molecule of (c), e.g., a promoter described herein. The promoter and second promoter differ from one another. In an embodiment, the promoter and second promoter are the same.

The nucleic acids described herein may further comprise a promoter operably linked to the sequence that encodes the RNA-guided nuclease (e.g., a Cas9 molecule) of (b), e.g., a promoter described herein.

In another aspect, disclosed herein is a composition comprising (a) a gRNA molecule comprising a targeting domain that is complementary with a target domain in the SERPINA1 gene, as described herein. The composition of (a) may further comprise (b) an RNA-guided nuclease (e.g., Cas9 molecule) as described herein. A composition of (a) and (b) may further comprise (c) a second, third and/or fourth gRNA molecule, e.g., a second, third and/or fourth gRNA molecule described herein. A composition of (a), (b) and (c) may further comprise (d) a template nucleic acid (in an embodiment where an exogenous template is used). In an embodiment, the composition is a pharmaceutical composition. The Compositions described herein, e.g., pharmaceutical compositions described herein, can be used in treating A1AT deficiency in a subject, e.g., in accordance with a method disclosed herein.

In another embodiment, when (e) a nucleic acid comprising a full-length or partial coding sequence of SERPINA1 gene, a promoter, and a polyadenylation signal, is present, each of (a), (b), (c)(i) and (e) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i) and (e) may be present on the different nucleic acid molecules, e.g., different vectors, e.g., the different viral vectors, e.g., different AAV vectors. In further embodiments, each of (a), (b), (c)(i) and (e) may be present on more than one nucleic acid molecule, but fewer than four nucleic acid molecules, e.g., AAV vectors.

In another aspect, disclosed herein is a method of altering a cell, e.g., altering the structure, e.g., altering the sequence, of a target nucleic acid of a cell, comprising contacting said cell with: (a) a gRNA that targets the SERPINA1 gene, e.g., a gRNA as described herein; (b) an RNA-guided nuclease (e.g., a Cas9 molecule) as described herein; and optionally, (c) a second, third and/or fourth gRNA that targets SERPINA1 gene or SERPINA1 gene, e.g., a gRNA; and optionally, (d) a template nucleic acid, as described herein.

In an embodiment, the method comprises contacting said cell with (a) and (b).

In an embodiment, the method comprises contacting said cell with (a), (b), and (c).

In an embodiment, the method comprises contacting said cell with (a), (b), (c) and (d).

In an embodiment, the gRNA targets the SERPINA1 gene and no exogenous template nucleic acid is contacted with the cell.

The targeting domain of the gRNA of (a) and optionally (c) may comprise a sequence set forth in SEQ ID NOs:253-2192, or a targeting domain comprising a sequence that differs by no more than 1, 2, 3, 4, or 5 nucleotides from a targeting domain sequence set forth in SEQ ID NOs:253-2192.

In an embodiment, the method comprises contacting a cell from a subject suffering from or likely to develop A1AT deficiency. The cell may be from a subject having a mutation at an A1AT target position in the SERPINA1 gene or a subject which would benefit from having a mutation at an A1AT target position in the SERPINA1 gene.

In an embodiment, the contacting may be performed ex vivo and the contacted cell may be returned to the subject's body after the contacting step. In another embodiment, the contacting step may be performed in vivo.

In an embodiment, the method of altering a cell as described herein comprises acquiring knowledge of the sequence at an A1AT target position in said cell, prior to the contacting step. Acquiring knowledge of the sequence at an A1AT target position in the cell may be by sequencing the SERPINA1 gene, or a portion of the SERPINA1 gene.

In an embodiment, the contacting step of the method comprises contacting the cell with a nucleic acid, e.g., a vector, e.g., an AAV vector, that expresses at least one of (a), (b), and (c). In an embodiment, the contacting step of the method comprises contacting the cell with a nucleic acid, e.g., a vector, e.g., an AAV vector, that expresses each of (a), (b), and (c).

In another embodiment, the contacting step of the method comprises delivering to the cell an RNA-guided nuclease (e.g., Cas9 molecule) of (b) and a nucleic acid which encodes a gRNA (a) and optionally, a second gRNA (c)(i) (and further optionally, a third gRNA (c)(iv) and/or fourth gRNA (c)(iii).

In an embodiment, the contacting step of the method comprises contacting the cell with a nucleic acid, e.g., a vector, e.g., an AAV vector, that expresses at least one of (a), (b), (c) and (d). In an embodiment, the contacting step of the method comprises contacting the cell with a nucleic acid, e.g., a vector, e.g., an AAV vector, that expresses each of (a), (b), and (c). In another embodiment, the contacting step of the method comprises delivering to the cell an RNA-guided nuclease (e.g., Cas9 molecule) of (b), a nucleic acid which encodes a gRNA of (a) and a template nucleic acid of (d), and optionally, a second gRNA (c)(i) (and further optionally, a third gRNA (c)(iv) and/or fourth gRNA (c)(iii).

In an embodiment, contacting comprises contacting the cell with a nucleic acid, e.g., an AAV1 vector, an AAV2 vector, a modified AAV2 vector, an AAV3 vector, a modified AAV3 vector, an AAV4 vector, a modified AAV4 vector, an AAV5 vector, a modified AAV5 vector, an AAV6 vector, a modified AAV6 vector, an AAV7 vector, a modified AAV7 vector, an AAV8 vector, a modified AAV8 vector, an AAV9 vector, a modified AAV9 vector, an AAV.rh10 vector, a modified AAV.rh10 vector, an AAV.rh32/33 vector, a modified AAV.rh32/33 vector, an AAV.rh64 vector, a modified AAV.rh64 vector, and a chimeric AAV vector.

In an embodiment, contacting comprises delivering to the cell an RNA-guided nuclease (e.g., a Cas9 molecule) of (b), as a protein or an mRNA, and a nucleic acid which encodes (a) and optionally a second, third and/or fourth gRNA of (c).

In an embodiment, contacting comprises delivering to the cell an RNA-guided nuclease (e.g., a Cas9 molecule) of (b), as a protein or an mRNA, said gRNA of (a), as an RNA, and optionally said second, third and/or fourth gRNA of (c), as an RNA.

In an embodiment, contacting comprises delivering to the cell a gRNA of (a) as an RNA, optionally said second, third and/or fourth gRNA of (c) as an RNA, and a nucleic acid that encodes the RNA-guided nuclease (e.g., a Cas9 molecule) of (b).

In another aspect, disclosed herein is a method of treating or preventing a subject suffering from or likely to develop A1AT deficiency, e.g., altering the structure, e.g., sequence, of a target nucleic acid of the subject, comprising contacting the subject (or a cell from the subject) with:

(a) a gRNA that targets the SERPINA1 gene, e.g., a gRNA disclosed herein;

(b) an RNA-guided nuclease (e.g., a Cas9 molecule) disclosed herein; and optionally, (c)(i) a second gRNA that targets the SERPINA1 gene, e.g., a second gRNA disclosed herein, and further optionally, (c)(ii) a third gRNA, and still further optionally, (c)(iii) a fourth gRNA that target the SERPINA1 gene, e.g., a third and fourth gRNA disclosed herein.

The method of treating a subject may further comprise contacting the subject (or a cell from the subject) with (d) a template nucleic acid (in an embodiment where an exogenous template is used), e.g., a template nucleic acid disclosed herein.

In an embodiment, a template nucleic acid is used when the method of treating a subject uses HDR to alter the sequence of the target nucleic acid of the subject.

In an embodiment, contacting comprises contacting with (a) and (b).

In an embodiment, contacting comprises contacting with (a), (b), and (c)(i).

In an embodiment, contacting comprises contacting with (a), (b), (c)(i) and (c)(ii).

In an embodiment, contacting comprises contacting with (a), (b), (c)(i), (c)(ii) and (c)(iii).

In an embodiment, contacting comprises contacting with (a), (b), (c)(i) and (d).

In an embodiment, contacting comprises contacting with (a), (b), (c)(i), (c)(ii) and (d).

In an embodiment, contacting comprises contacting with (a), (b), (c)(i), (c)(ii), (c)(iii) and (d).

The targeting domain of the gRNA of (a) or (c) (e.g., (c)(i), (c)(ii), or (c)(iii) may comprise a sequence set forth in SEQ ID NOs:253-2192, or a sequence that differs by no more than 1, 2, 3, 4, or 5 nucleotides from a sequence set forth in SEQ ID NOs:253-2192.

In an embodiment, the method comprises acquiring knowledge of the sequence (e.g., a mutation) of an A1AT target position in said subject.

In an embodiment, the method comprises acquiring knowledge of the sequence (e.g., a mutation) of an A1AT target position in said subject by sequencing the SERPINA1 gene or a portion of the SERPINA1 gene.

In an embodiment, the method comprises correcting a mutation at an A1AT target position in the SERPINA1 gene.

In an embodiment, the method comprises correcting a mutation at an A1AT target position in the SERPINA1 gene by HDR.

In an embodiment, the method comprises introducing a mutation at an A1AT target position in the SERPINA1 gene.

In an embodiment, the method comprises introducing a mutation at an A1AT target position in the SERPINA1 gene by NHEJ.

When the method comprises correcting the mutation at an A1AT target position by HDR, an RNA-guided nuclease (e.g., a Cas9 molecule) of (b), at least one guide RNA, e.g., a guide RNA of (a) and a template nucleic acid of (d) are included in the contacting step.

In an embodiment, a cell of the subject is contacted ex vivo with (a), (b), (d) and optionally (c)(i), further optionally (c)(ii), and still further optionally (c)(iii). In an embodiment, said cell is returned to the subject's body.

In an embodiment, a cell of the subject is contacted is in vivo with (a), (b) (d) and optionally (c)(i), further optionally (c)(ii), and still further optionally (c)(iii).

In an embodiment, the cell of the subject is contacted in vivo by intravenous delivery of (a), (b), (d) and optionally (c)(i), further optionally (c)(ii), and still further optionally (c)(iii).

In an embodiment, the cell of the subject is contacted in vivo by intramuscular delivery of (a), (b), (d) and optionally (c)(i), further optionally (c)(ii), and still further optionally (c)(iii).

In an embodiment, the cell of the subject is contacted in vivo by subcutaneous delivery of (a), (b), (d) and optionally (c)(i), further optionally (c)(ii), and still further optionally (c)(iii).

In an embodiment, the cell of the subject is contacted in vivo by intra-bone marrow (IBM) delivery of (a), (b), (d) and optionally (c)(i), further optionally (c)(ii), and still further optionally (c)(iii).

In an embodiment, contacting comprises contacting the subject with a nucleic acid, e.g., a vector, e.g., an AAV vector, described herein, e.g., a nucleic acid that encodes at least one of (a), (b), (d) and optionally (c)(i), further optionally (c)(ii), and still further optionally (c)(iii).

In an embodiment, contacting comprises delivering to said subject said RNA-guided nuclease (e.g., a Cas9 molecule) of (b), as a protein or mRNA, and a nucleic acid which encodes (a), a nucleic acid of (d) and optionally (c)(i), further optionally (c)(ii), and still further optionally (c)(iii).

In an embodiment, contacting comprises delivering to the subject the RNA-guided nuclease (e.g., a Cas9 molecule) of (b), as a protein or mRNA, the gRNA of (a), as an RNA, a nucleic acid of (d) and optionally the second, third and/or fourth gRNA of (c), as an RNA.

In an embodiment, contacting comprises delivering to the subject the gRNA of (a), as an RNA, optionally said second, third and/or fourth gRNA of (c), as an RNA, a nucleic acid that encodes the RNA-guided nuclease (e.g., a Cas9 molecule) of (b), and a nucleic acid of (d).

When the method comprises (1) introducing a mutation at an A1AT target position by NHEJ or (2) knocking down expression of the SERPINA1 gene by targeting the promoter region, an RNA-guided nuclease (e.g., a Cas9 molecule) of (b) and at least one guide RNA, e.g., a guide RNA of (a) are included in the contacting step.

In an embodiment, a cell of the subject is contacted ex vivo with (a), (b) and optionally (c)(i), further optionally (c)(ii), and still further optionally (c)(iii). In an embodiment, said cell is returned to the subject's body.

In an embodiment, a populations of cells from a subject is contacted ex vivo with (a), (b) and optionally (c) to correct the mutations in the SERPINA1 gene that result in the expression of an A1AT mutant protein comprising an amino acid mutation at E342K and/or E264V and a second population of cells from the subject is contacted ex vivo with (a), (b) and optionally (c) to introduce a mutation in the SERPINA1 gene to knockout the SERPINA1 gene. A mixture of the two cell populations may be returned to the subject's body to treat or prevent A1AT deficiency.

In an embodiment, a cell of the subject is contacted is in vivo with (a), (b) and optionally (c)(i), further optionally (c)(ii), and still further optionally (c)(iii). In an embodiment, the cell of the subject is contacted in vive by intravenous delivery of (a), (b) and optionally (c)(i), further optionally (c)(ii), and still further optionally (c)(iii). In an embodiment, the cell of the subject is contacted in vive by intramuscular delivery of (a), (b) and optionally (c)(i), further optionally (c)(ii), and still further optionally (c)(iii). In an embodiment, the cell of the subject is contacted in vive by subcutaneous delivery of (a), (b) and optionally (c)(i), further optionally (c)(ii), and still further optionally (c)(iii). In an embodiment, the cell of the subject is contacted in vivo by intra-bone marrow (IBM) delivery of (a), (b) and optionally (c)(i), further optionally (c)(ii), and still further optionally (c)(iii).

In an embodiment, contacting comprises contacting the subject with a nucleic acid, e.g., a vector, e.g., an AAV vector, described herein, e.g., a nucleic acid that encodes at least one of (a), (b), and optionally (c)(i), further optionally (c)(ii), and still further optionally (c)(iii).

In an embodiment, contacting comprises delivering to said subject said RNA-guided nuclease (e.g., Cas9 molecule) of (b), as a protein or mRNA, and a nucleic acid which encodes (a) and optionally (c)(i), further optionally (c)(ii), and still further optionally (c)(iii).

In an embodiment, contacting comprises delivering to the subject the RNA-guided nuclease (e.g., a Cas9 molecule) of (b), as a protein or mRNA, the gRNA of (a), as an RNA, and optionally the second, third and/or fourth gRNA of (c), as an RNA.

In an embodiment, contacting comprises delivering to the subject the gRNA of (a), as an RNA, optionally said second, third and/or fourth gRNA of (c), as an RNA, and a nucleic acid that encodes the RNA-guided nuclease (e.g., a Cas9 molecule) of (b).

In another aspect, disclosed herein is a reaction mixture comprising a gRNA, a nucleic acid, or a composition described herein, and a cell, e.g., a cell from a subject having, or likely to develop A1AT deficiency, or a subject having a mutation at an A1AT target position in the SERPINA1 gene, or a cell from a subject which would benefit from having a mutation at an A1AT target position in the SERPINA1 gene.

In another aspect, disclosed herein is a kit comprising, (a) gRNA molecule described herein, or nucleic acid that encodes the gRNA, and one or more of the following: (b) an RNA-guided nuclease (e.g., a Cas9 molecule) described herein, or a nucleic acid or mRNA that encodes the RNA-guided nuclease (e.g., a Cas9 molecule);

(c)(i) a second gRNA molecule, e.g.; a second gRNA molecule described herein or a nucleic acid that encodes (c)(i);

(c)(ii) a third gRNA molecule, e.g., a second gRNA molecule described herein or a nucleic acid that encodes (c)(ii);

(c)(iii) a fourth gRNA molecule, e.g., a second gRNA molecule described herein or a nucleic acid that encodes (c)(iii);

(d) a template nucleic acid (in an embodiment where an exogenous template is used), e.g., a template nucleic acid described herein.

In an embodiment, the kit comprises nucleic acid, e.g., an AAV vector, that encodes one or more of (a), (b), (c)(i), (c)(ii), (c)(iii) and (d).

In an aspect, the disclosure features a gRNA molecule, referred to herein as a governing gRNA molecule, comprising a targeting domain which is complementary to a target domain on a nucleic acid that encodes a component of the CRISPR/RNA-guided nuclease system introduced into a cell or subject. In an embodiment, the governing gRNA molecule targets a nucleic acid that encodes an RNA-guided nuclease (e.g., a Cas9 molecule) or a nucleic acid that encodes a target gene gRNA molecule. In an embodiment, the governing gRNA comprises a targeting domain that is complementary to a target domain in a sequence that encodes an RNA-guided nuclease component (e.g., a Cas9 molecule) or target gene gRNA molecule. In an embodiment, the target domain is designed with, or has, minimal homology to other nucleic acid sequences in the cell, e.g., to minimize off-target cleavage. For example, the targeting domain on the governing gRNA can be selected to reduce or minimize off-target effects. In an embodiment, a target domain for a governing gRNA can be disposed in the control or coding region of an RNA-guided nuclease (e.g., a Cas9 molecule) or disposed between a control region and a transcribed region. In an embodiment, a target domain for a governing gRNA can be disposed in the control or coding region of a target gene gRNA molecule or disposed between a control region and a transcribed region for a target gene gRNA. While not wishing to be bound by theory, it is believed that altering, e.g., inactivating, a nucleic acid that encodes an RNA-guided nuclease (e.g., a Cas9 molecule) or a nucleic acid that encodes a target gene gRNA molecule can be effected by cleavage of the targeted nucleic acid sequence or by binding of an RNA-guided nuclease (e.g., a Cas9 molecule)/governing gRNA molecule complex to the targeted nucleic acid sequence.

The compositions, reaction mixtures and kits, as disclosed herein, can also include a governing gRNA molecule, e.g., a governing gRNA molecule disclosed herein.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

BRIEF DESCRIPTION OF THE DRAWINGS

FIGS. 1A-1I are representations of several exemplary gRNAs.

FIG. 1A depicts a modular gRNA molecule derived in part (or modeled on a sequence in part) from *Streptococcus pyogenes* (*S. pyogenes*) as a duplexed structure (SEQ ID NOs:39 and 40, respectively, in order of appearance);

FIG. 1B depicts a unimolecular gRNA molecule derived in part from *S. pyogenes* as a duplexed structure (SEQ ID NO:41);

FIG. 1C depicts a unimolecular gRNA molecule derived in part from *S. pyogenes* as a duplexed structure (SEQ ID NO:42);

FIG. 1D depicts a unimolecular gRNA molecule derived in part from *S. pyogenes* as a duplexed structure (SEQ ID NO:43);

FIG. 1E depicts a unimolecular gRNA molecule derived in part from *S. pyogenes* as a duplexed structure (SEQ ID NO:44);

FIG. 1F depicts a modular gRNA molecule derived in part from *Streptococcus thermophilus* (*S. thermophilus*) as a duplexed structure (SEQ ID NOs:45 and 46, respectively, in order of appearance);

FIG. 1G depicts an alignment of modular gRNA molecules of *S. pyogenes* and *S. thermophilus* (SEQ ID NOs:39, 45, 47, and 46, respectively, in order of appearance).

FIGS. 1H-1I depicts additional exemplary structures of unimolecular gRNA molecules.

FIG. 1H shows an exemplary structure of a unimolecular gRNA molecule derived in part from *S. pyogenes* as a duplexed structure (SEQ ID NO:42).

FIG. 1I shows an exemplary structure of a unimolecular gRNA molecule derived in part from *S. aureus* as a duplexed structure (SEQ ID NO:38).

FIGS. 2A-2G depict an alignment of Cas9 sequences (Chylinski 2013). The N-terminal RuvC-like domain is boxed and indicated with a "Y." The other two RuvC-like domains are boxed and indicated with a "B." The HNH-like domain is boxed and indicated by a "G." Sm: *S. mutans* (SEQ ID NO:1); Sp: *S. pyogenes* (SEQ ID NO:2); St: *S. thermophilus* (SEQ ID NO:4); and Li: *L. innocua* (SEQ ID NO:5). "Motif" (SEQ ID NO: 14) is a consensus sequence based on the four sequences. Residues conserved in all four sequences are indicated by single letter amino acid abbreviation; "*" indicates any amino acid found in the corresponding position of any of the four sequences; and "-" indicates absent.

FIGS. 3A-3B show an alignment of the N-terminal RuvC-like domain from the Cas9 molecules disclosed in Chylinski 2013 (SEQ ID NOs:52-95, 120-123). The last line of FIG. 3B identifies 4 highly conserved residues.

FIGS. 4A-4B show an alignment of the N-terminal RuvC-like domain from the Cas9 molecules disclosed in Chylinski 2013 with sequence outliers removed (SEQ ID NOs:52-123). The last line of FIG. 4B identifies 3 highly conserved residues.

FIGS. 5A-5C show an alignment of the HNH-like domain from the Cas9 molecules disclosed in Chylinski 2013 (SEQ ID NOs:124-198). The last line of FIG. 5C identifies conserved residues.

FIGS. 6A-6B show an alignment of the HNH-like domain from the Cas9 molecules disclosed in Chylinski 2013 with sequence outliers removed (SEQ ID NOs:124-141, 148, 149, 151-153, 162, 163, 166-174, 177-187, 194-198). The last line of FIG. 6B identifies 3 highly conserved residues.

FIG. 8A shows the organization of the Cas9 domains, including amino acid positions, in reference to the two lobes of Cas9 (recognition (REC) and nuclease (NUC) lobes). FIG. 8B shows the percent homology of each domain across 83 Cas9 orthologs.

FIG. 17A-L provides sequences for various vectors used in the examples herein. (A) pSS99-1: pTR-TBG-saCas9-bGH (7308 bp). (B) pSS99-4: pTR-CMV-saCas9-bGH (7444 bp). (C) pSS111-1: pTR-CMV-hAAT-bGH (5483 bp). (D) pSS111: CMV-hAAT-bGH (4509 bp). (E) pSS112: pTR-gRNA-203-EFS comprising targeting domain of SEQ ID NO:1390 (7362 bp). (F) pSS113: pTR-gRNA-333-EFS-minpA comprising targeting domain of SEQ ID NO:1811 (7362 bp). (G) pSS114: pTR-gRNA-203-TBG-minpA comprising targeting domain of SEQ ID NO:1390 (7571 bp). (H) pSS115: pTR-gRNA-333-TBG-minpA comprising targeting domain of SEQ ID NO:1811 (7571 bp). (I) pMES04: U6-gRNA-1889 comprising the targeting domain of SEQ ID NO:2191 (2280 bp). (J) pMES06: p-TR-gRNA 1889Z-1.7kb_hom_HDR comprising the targeting domain of SEQ ID NO:706 (7018 bp). (K) pMES08: p-TR-gRNA1889Z-2kb-1.4kb_HDR comprising the targeting domain of SEQ ID NO:706 (7018 bp). (L) pSS79: p-CMVsaCas9-BGHpA (6702 bp). (M) pAF003: CMV-saCas9 (6474 bp).

FIG. 18A shows a schematic representation of the human SERPINA1 locus in PiZ patients and transgenic mice. SgRNA-203 (left arrow) and sgRNA-333 (right arrow) are shown on Exon II.

FIG. 18B shows the configurations of the four AAV8-CRISPR vectors tested in mice.

FIG. 18C shows a timeline of dosing and sample collections.

FIG. 18D shows indels measured by a T7 Endonuclease I (T7E1) Assay on hSERPINA1 loci in livers from PiZ transgenic mice at 35-day post injection.

FIG. 18E shows hSERPINA1 transcription levels relative to mouse B2M in PiZ mouse livers and the corresponding PBS-treated littermate measured by qRT-PCR.

FIG. 18F shows a representative RNAseq analysis at a DNA lesion from one PiZ mouse treated with AAV8-SS115.

FIG. 19A shows the concentration of human AAT in mouse serum measured by hAAT-specific ELISA.

FIG. 19B shows representative images of Periodic Acid-Schiff Staining after Diastase Treatment (PAS-D) staining of murine livers at 35-day post injection. Arrowheads, AAT globules. Scale bar, 100 um.

Quantitation of PAS-D staining images showing (FIG. 19C) total counts of AAT globules and (FIG. 19D) total areas of globules.

Figure 19A:
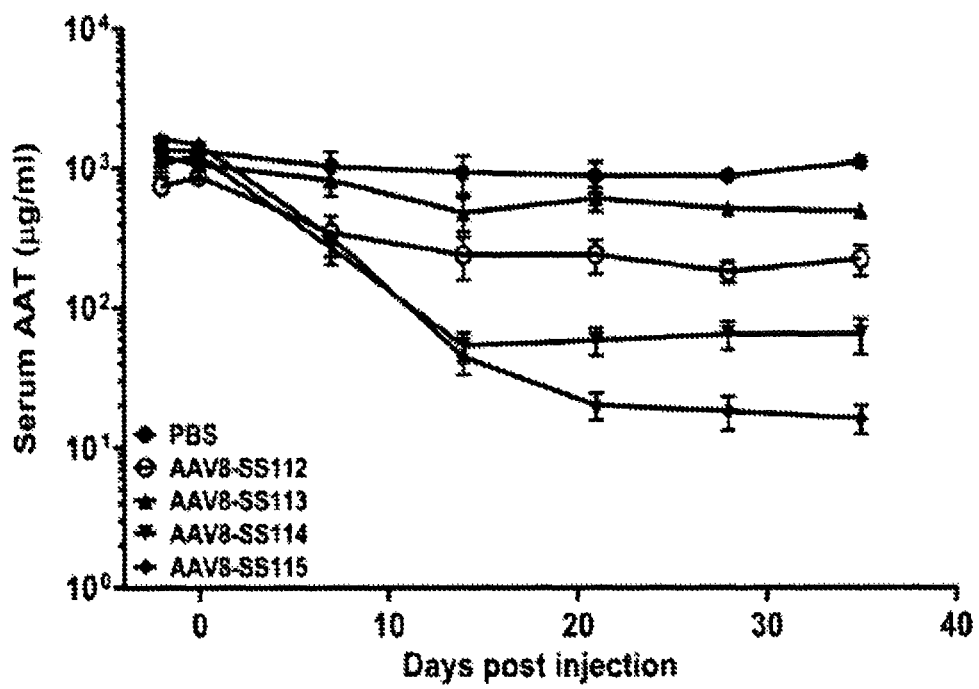
FIGS. 19A-G shows the correction of the liver phenotypes in PiZ transgenic mice by knocking down hSERPINA1 transcription with AAV8-CRISPR.
Figure 19B:
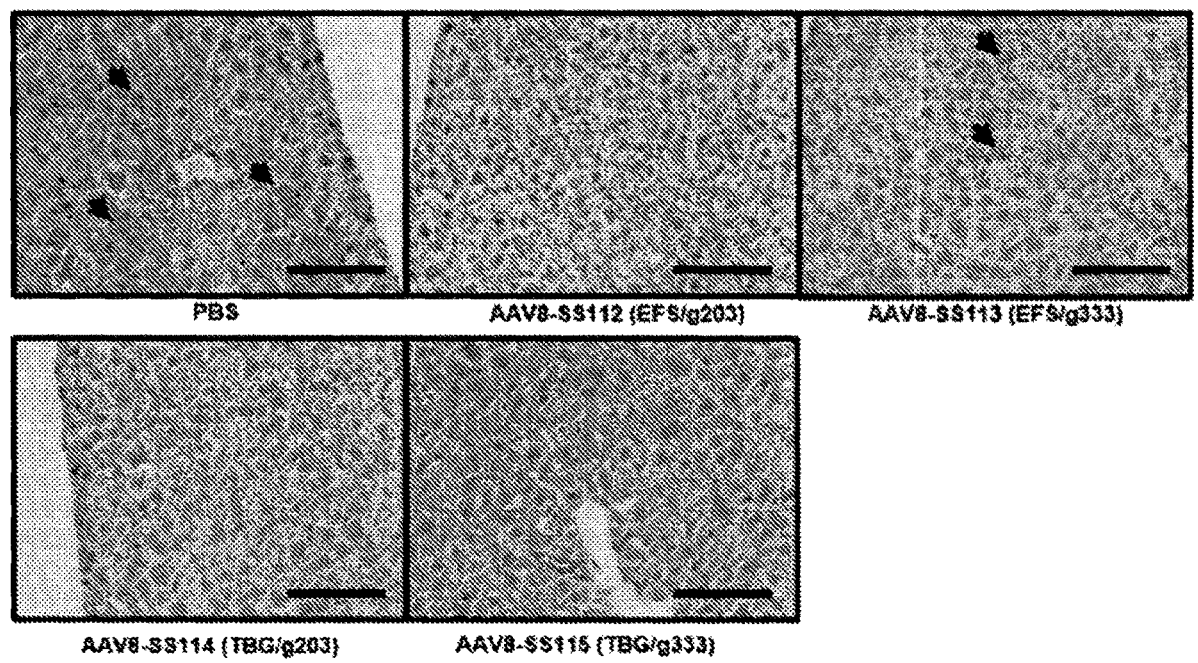
Figure 19C:
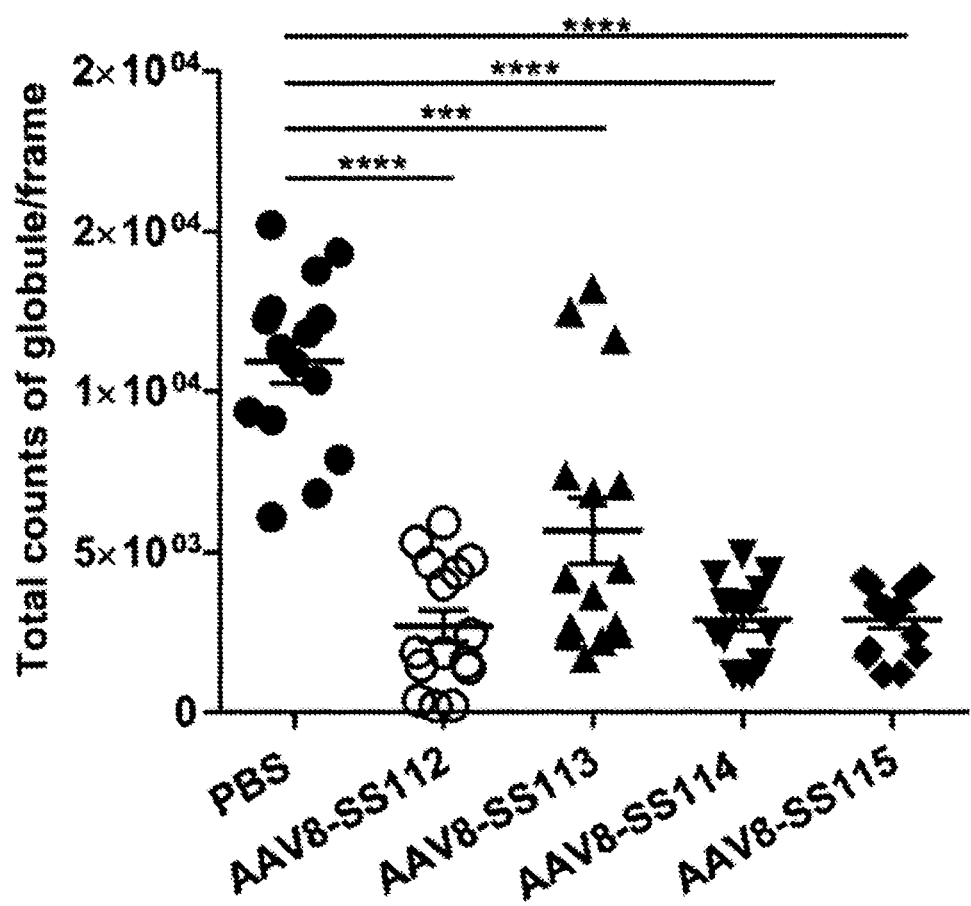
Figure 19D:
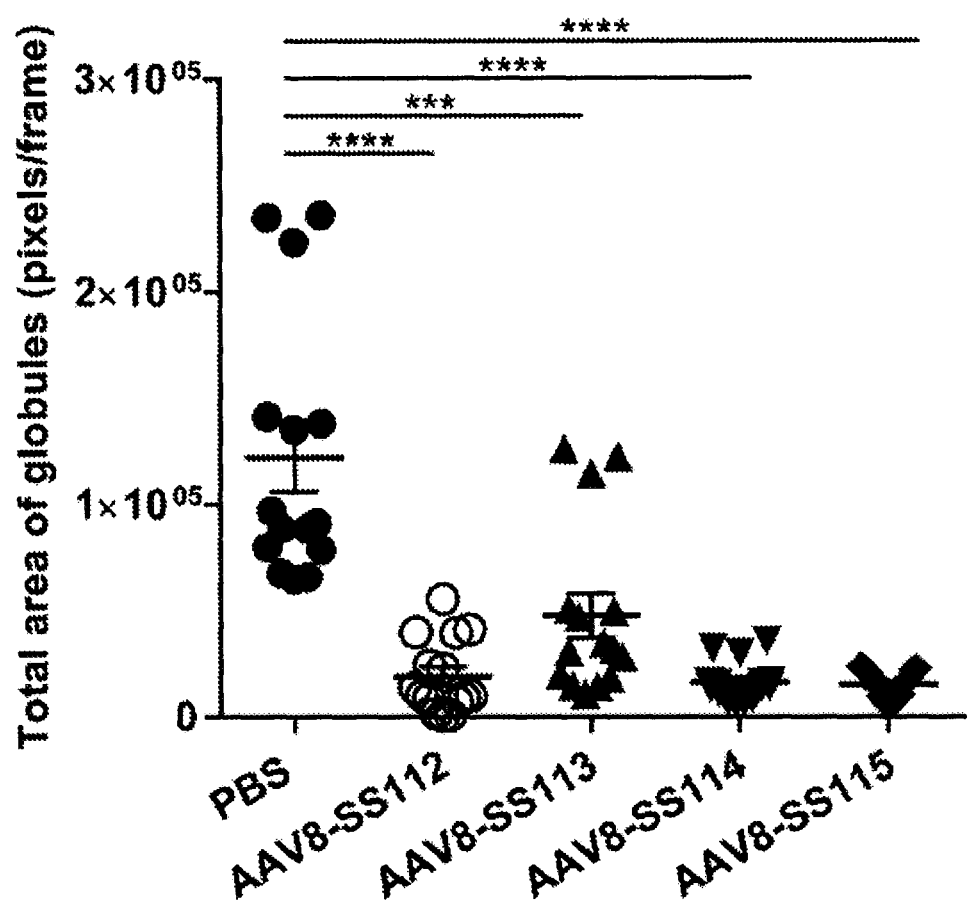
Figure 19E:
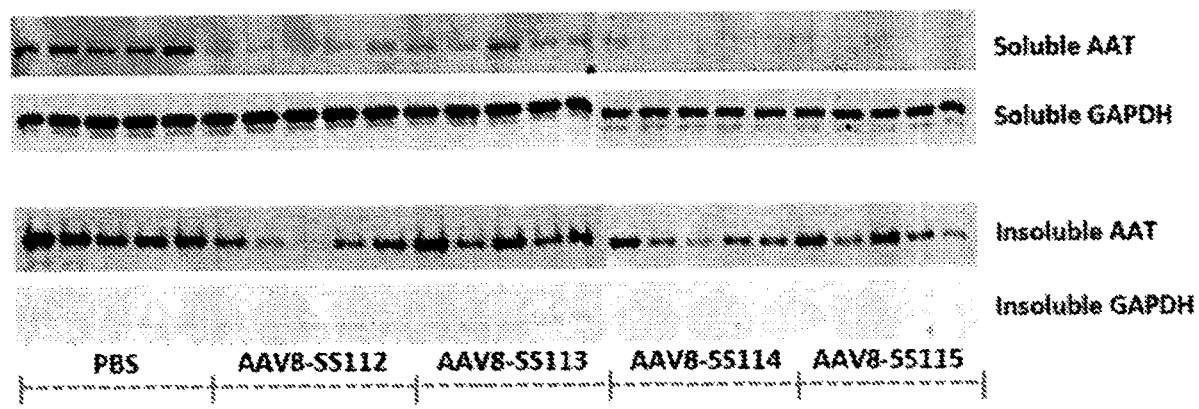

FIG. 19E shows Western blotting of soluble and insoluble hAAT in murine livers after AAV8-CRISPR treatment. Quantitation of (FIG. 19F) soluble and (FIG. 19G) insoluble AAT from Western blotting.

FIGS. 20A-D shows the correction of the Z-mutation with a dual-vector AAV8-CRISPR system in PiZ transgenic mice.

Figure 20A:
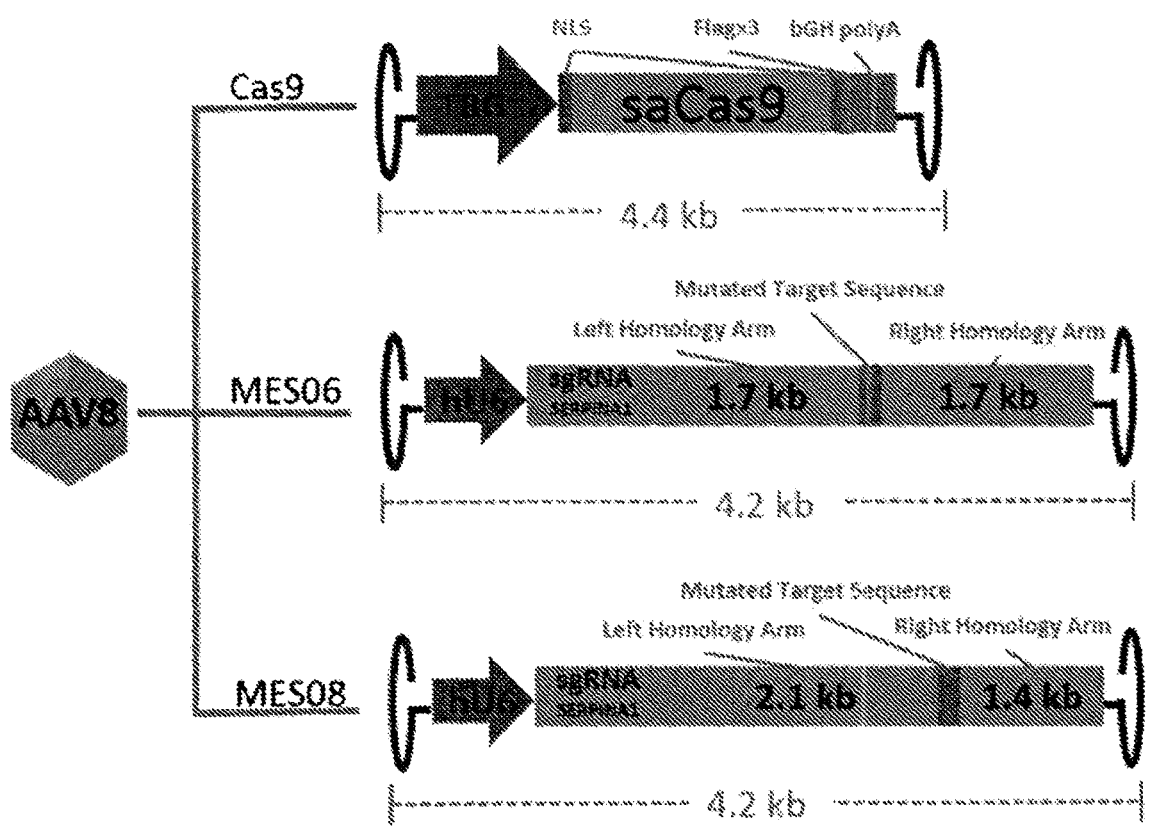

FIG. 20A shows the configuration of three AAV vectors tested in animals.

Figure 20B:
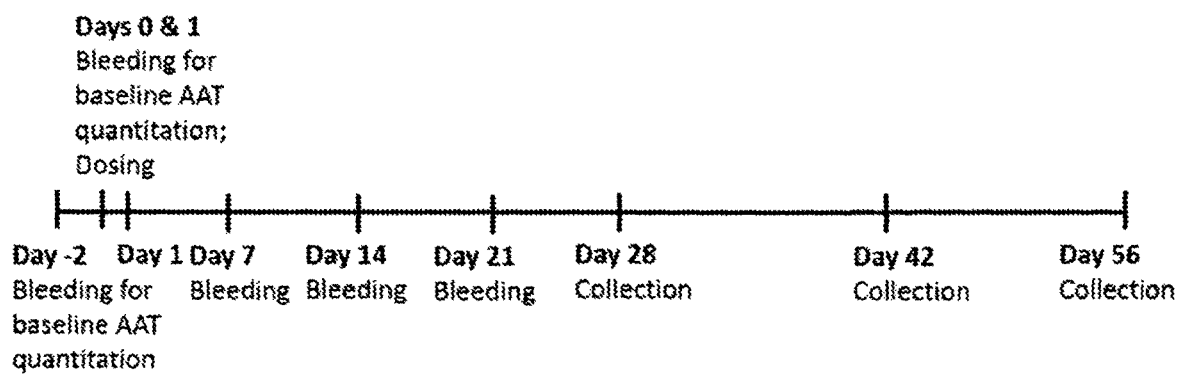

FIG. 20B shows the timeline of animal experiments.

Figure 20C:
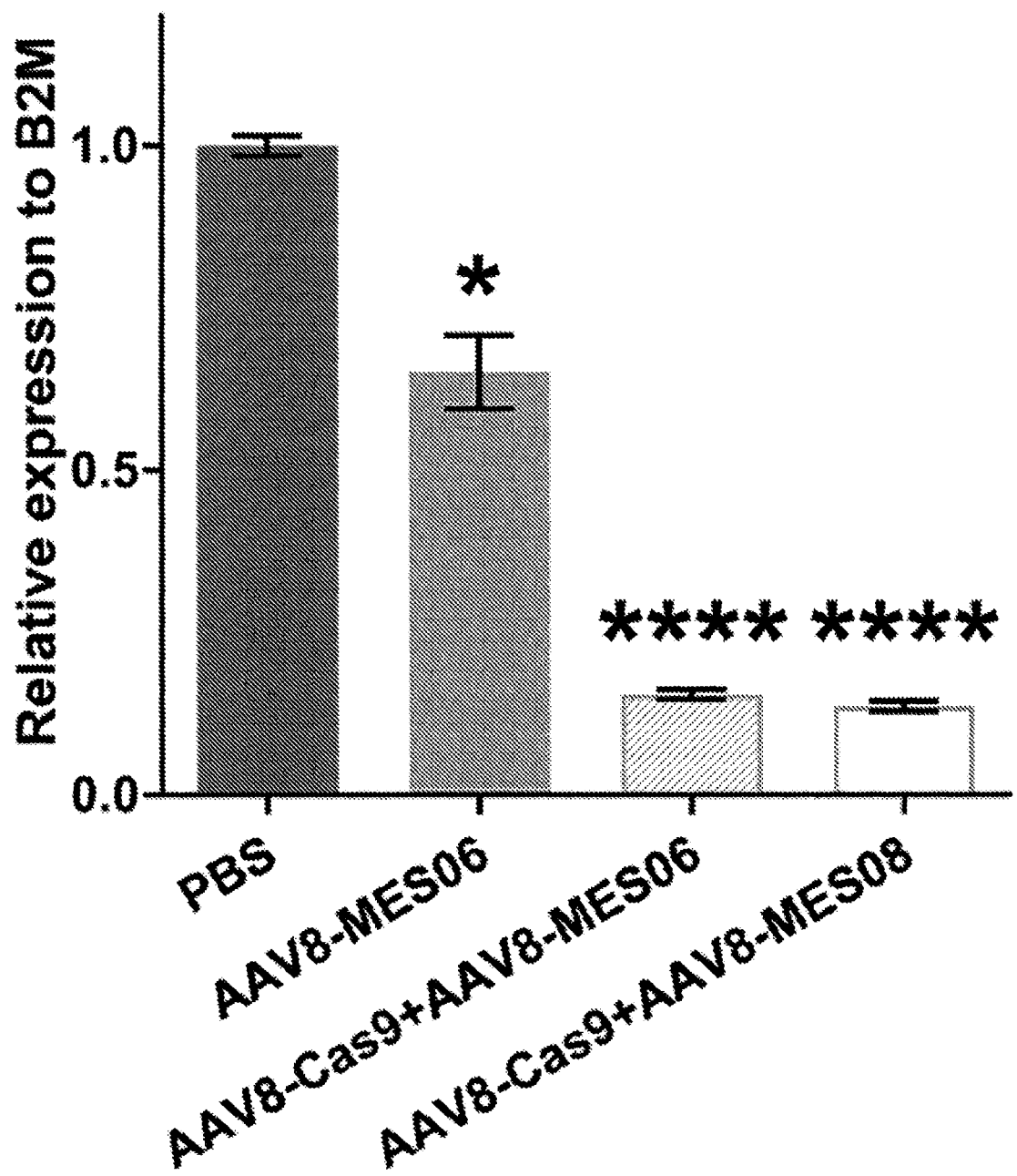

FIG. 20C shows RNAseq measurement of hSERPINA1 expression levels relative to mouse B2M at 56 days post treatment.

Figure 20D:
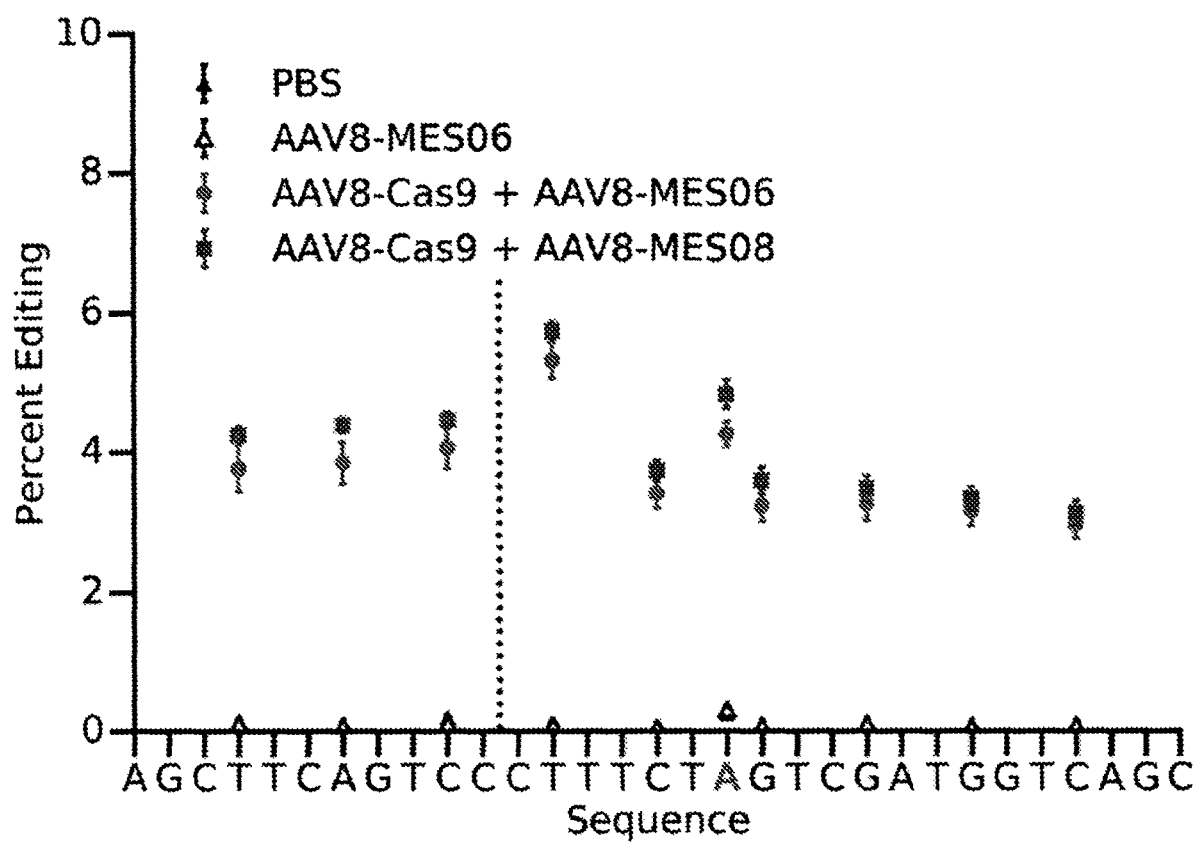

FIG. 20D shows RNAseq analysis showing nucleotide substitutions introduced by AAV8-MES06 or AAV8-MES08 near the saCas9 cut site. The arrow indicated the A nucleotide responsible for the Z mutation. Dotted line, cut site.

FIGS. 21A-D shows amelioration of the liver phenotypes in mice treated by a dual-vector AAV8-CRISPR system.

Figure 21A:
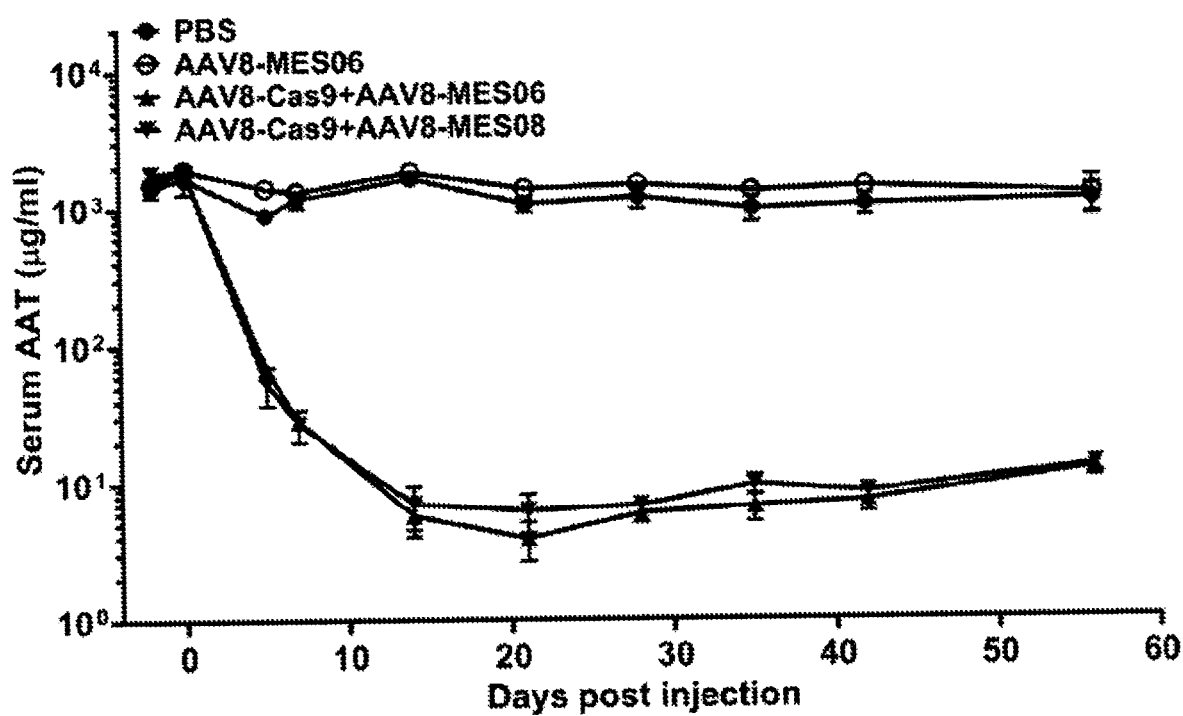

FIG. 21A shows the concentrations of circulating hAAT measured by ELISA from Day −2 to Day 56.

Figure 21B:
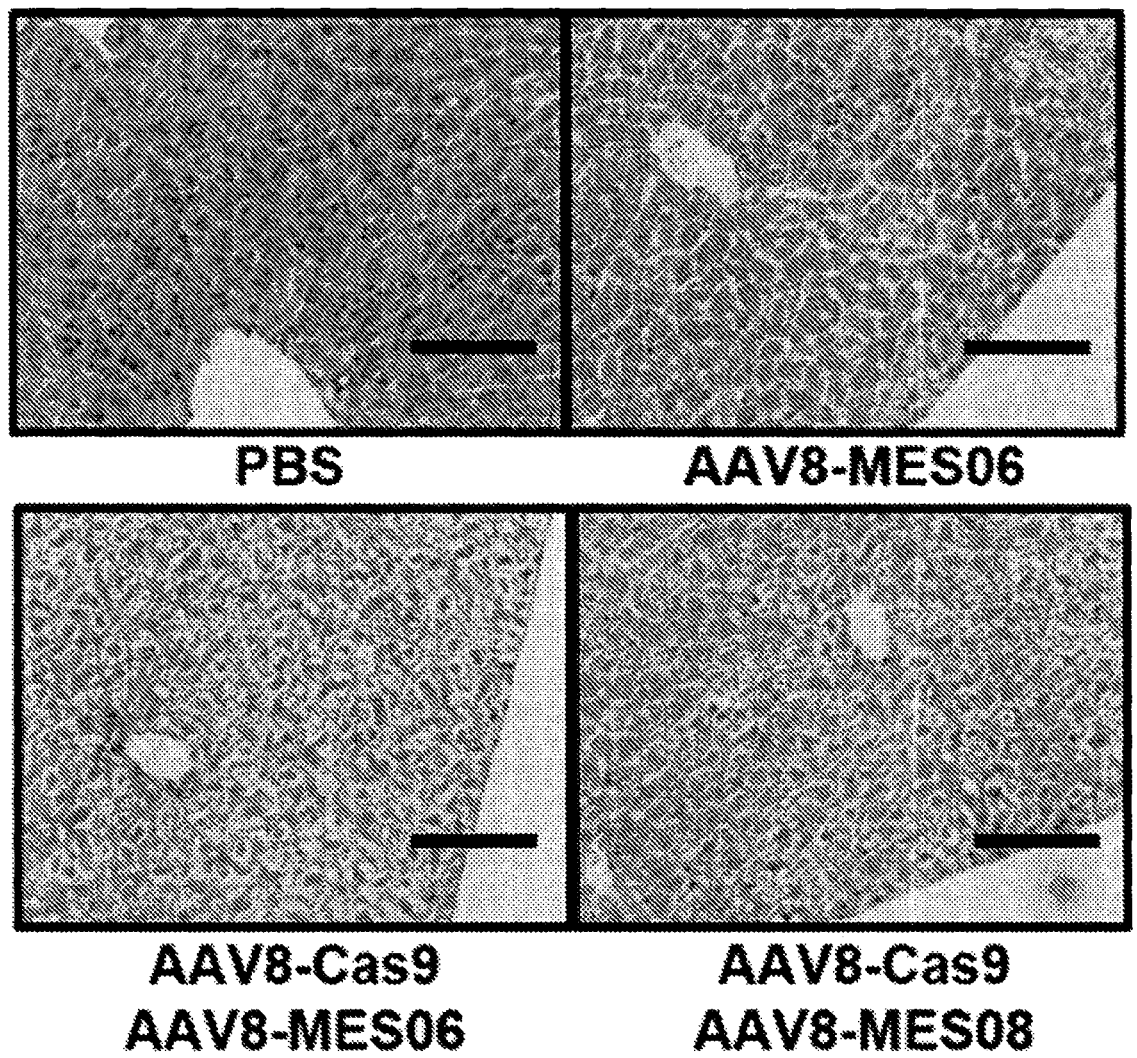

FIG. 21B shows representative PAS-D staining images at 56-day post injection. Scale bar, 100 um. Quantifications of total counts of AAT globules (FIG. 21C) and total areas of globules in a random location on liver tissues (FIG. 21D) from PAS-D staining at three time points post injection (28, 42, and 56 days).

FIG. 22 shows PAS-D staining images of livers from PiZ mice treated by All-in-One AAV vectors targeting Exon II of hSERPINA1.

Figure 23A:
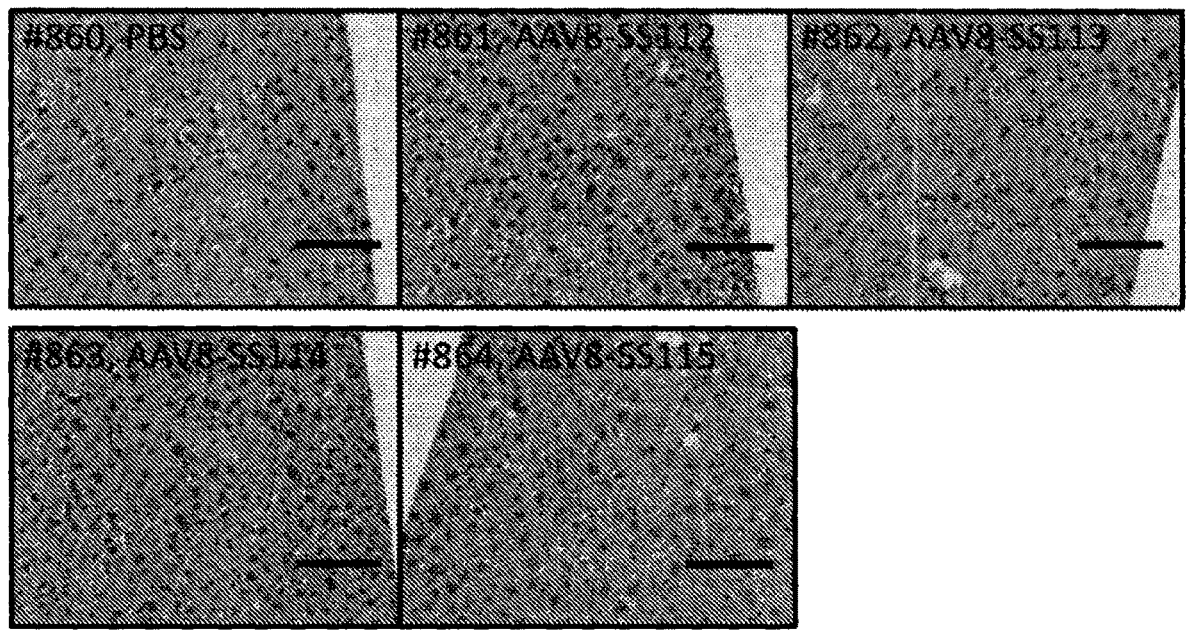
Figure 23B:
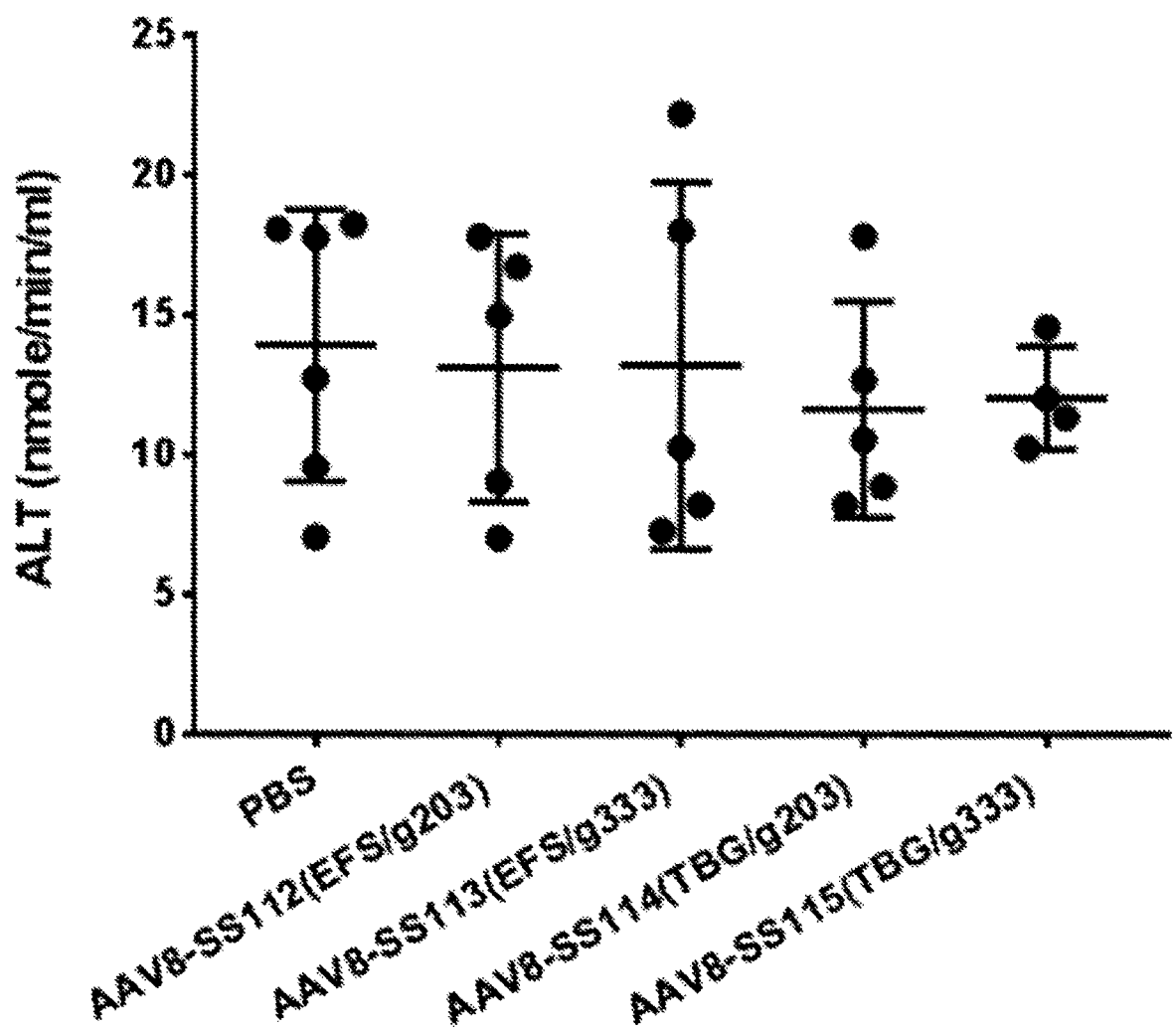
Figure 23C:
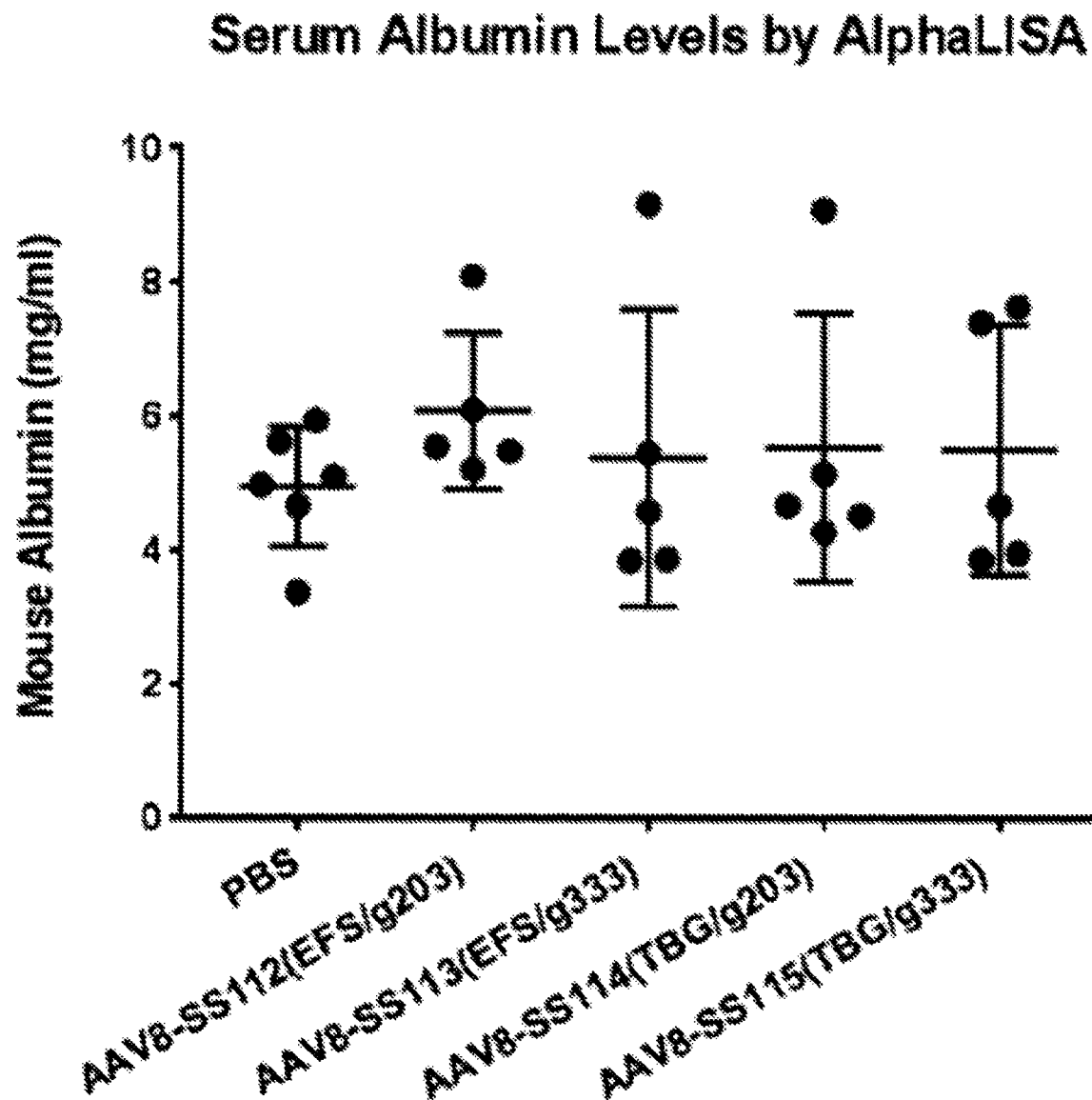
Figure 24A:
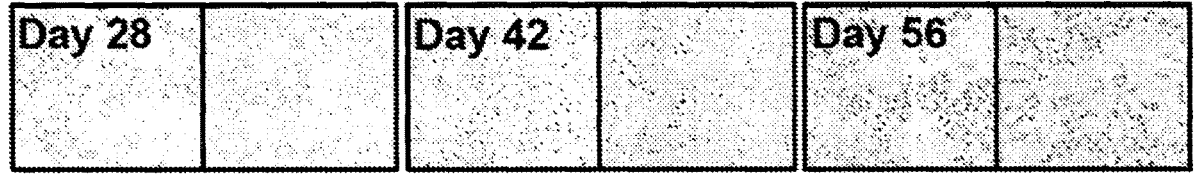
Figure 24B:
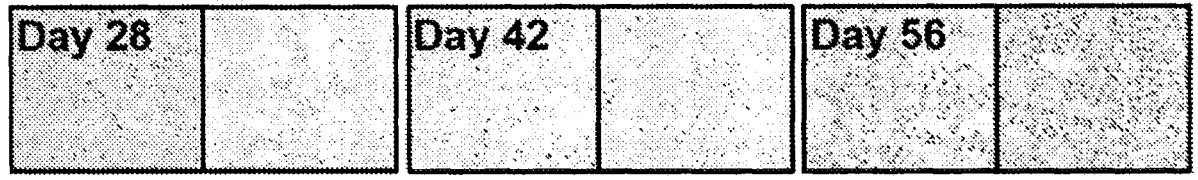
Figure 24C:
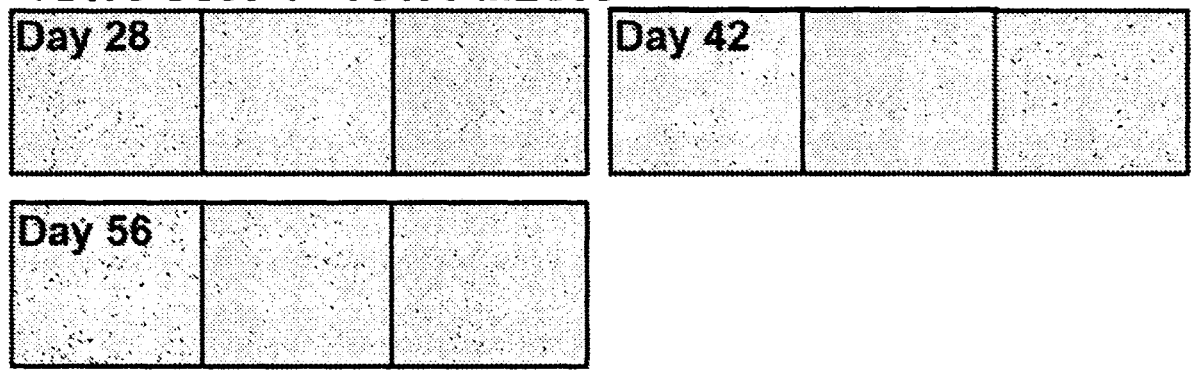
Figure 24D:
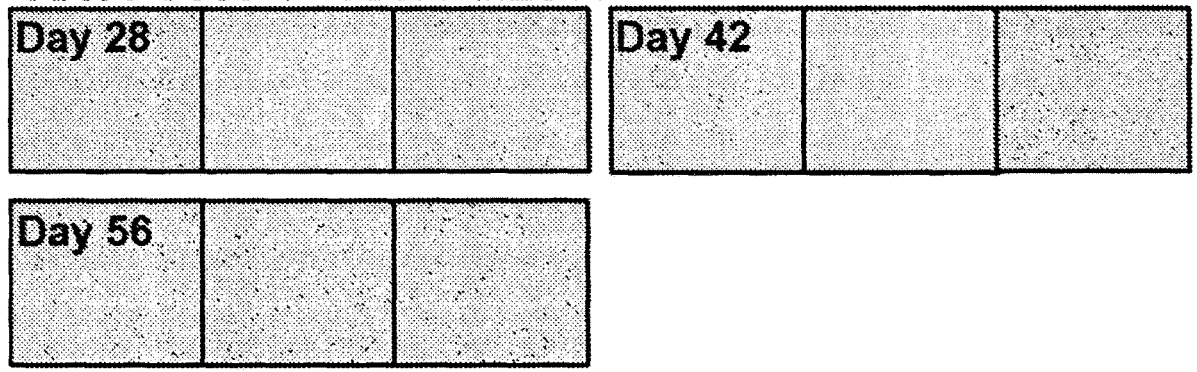

FIGS. 23A-C shows examination of liver toxicity in PiZ transgenic mice treated with AAV-CRISPR vectors. FIG. 23A shows histological analysis of livers transduced with AAV-CRISPR 35-day in PiZ transgenic mice. Liver alanine aminotransferase (ALT) levels measured by ELISA (FIG. 23B) and serum albumin levels measured by AlphaLISA (FIG. 23C) in PBS or 5e13 vg/kg of AAV-CRISPR treated PiZ transgenic mice at 35-day post injection. Data represent mean±s.e.m. There was no statistically significant differences among groups.

FIG. 24 shows PAS-D staining images of livers from PiZ mice treated by a dual-AAV-CRISPR system.

Figure 25:
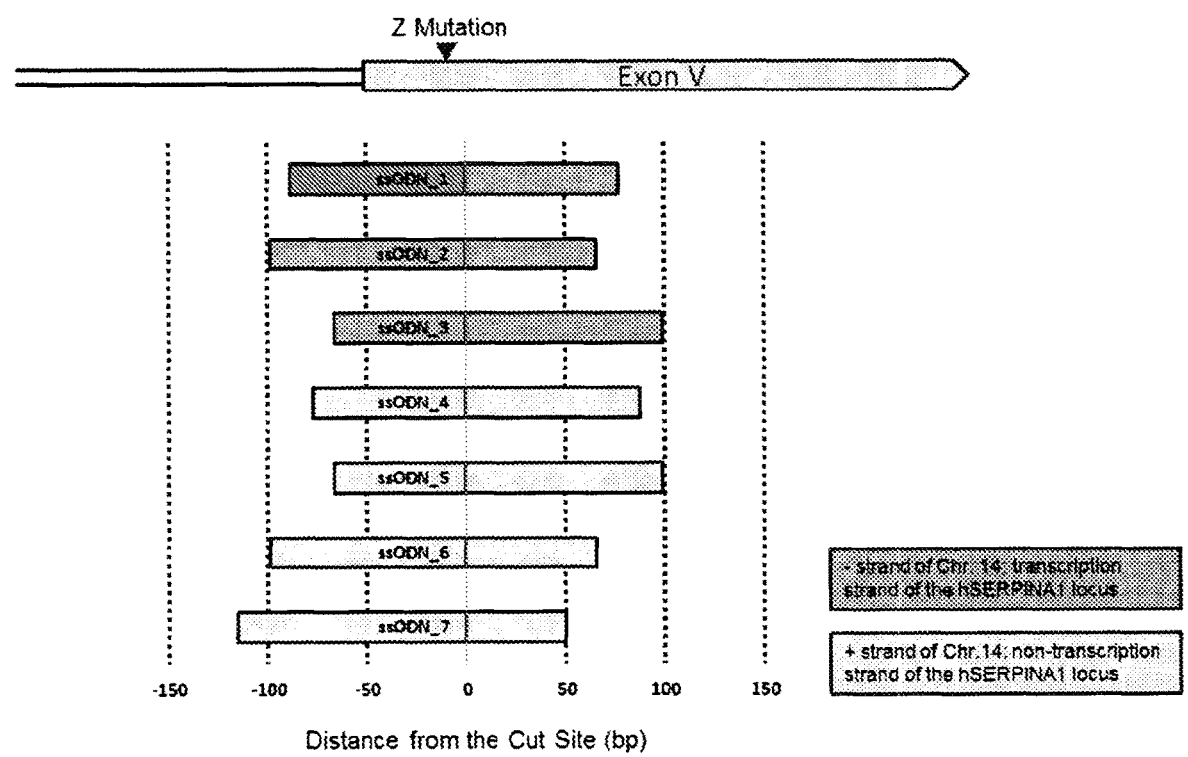

FIG. 25 shows a graph illustrating different ssODN configurations relative to the Z mutation on SERPINA1 locus.

Figure 26:
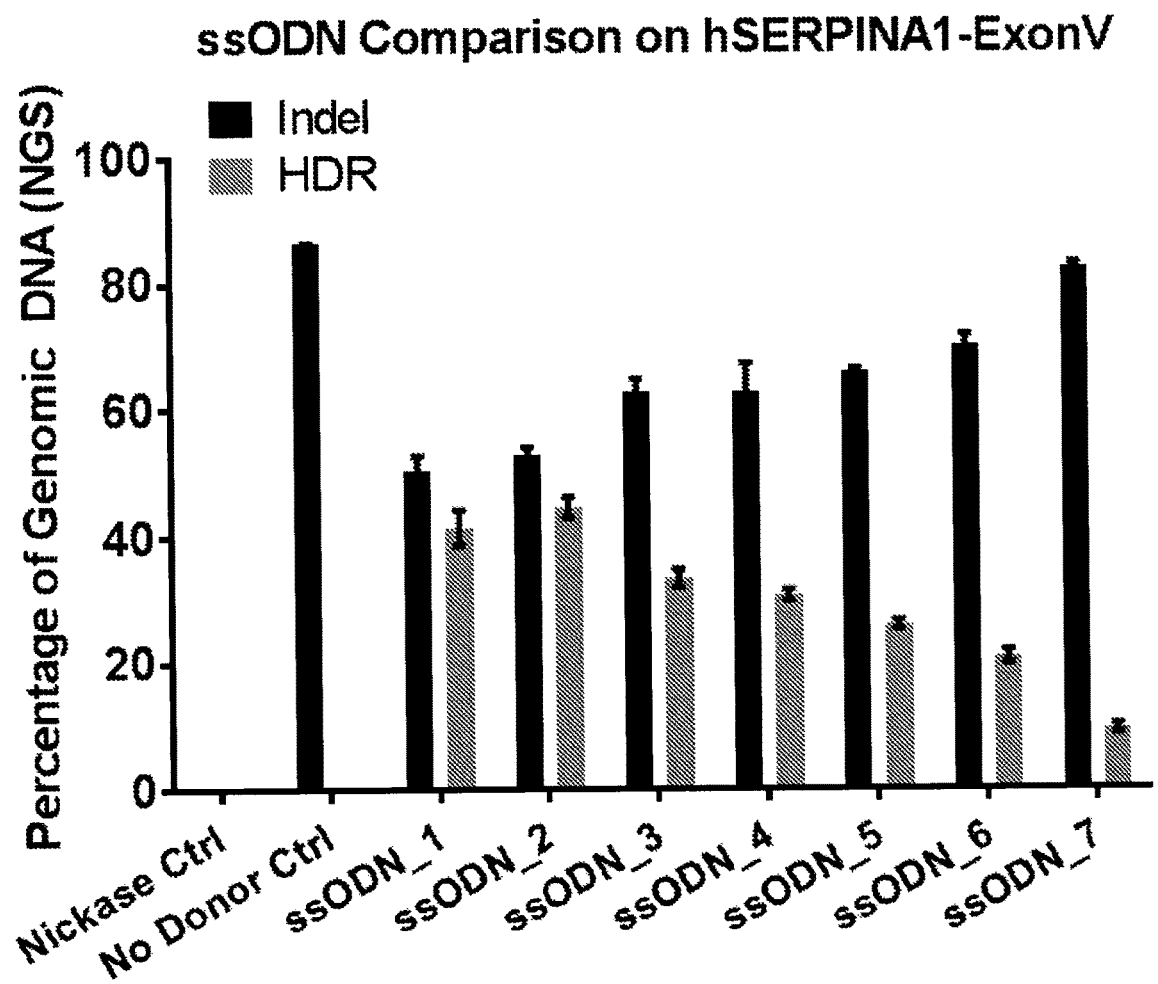

FIG. 26 shows Next Generation Sequencing (NGS) results from a comparison study of ssODNs having different configurations for introducing the Z-mutation to hSER-PINA1-ExonV by HDR in wild-type Hep3B cells. Hep3B cells were nucleofected with a combination of saCas9 plasmid, PCR fragments expressing sgRNA-1889, and ssODN as indicated (i.e., ssODN_1, ssODN_2, ssODN_3, ssODN_4, ssODN_5, ssODN_6, or ssODN_7). Three days post nucleofection, genomic DNA samples were harvested and NGS was used to sequence hSERPINA1-ExonV. Indel percentage represent total insertions and deletions near the sgRNA1889 cut site (break). HDR percentage represent the frequencies of gene editing events with all intended mutations incorporated into genomic DNA. N-4, error bars represent standard error of the mean (s.e.m.). "Nickase Ctrl" means saCas9-D10A nickase was added to the sample instead of wild-type saCas9 nuclease. "No Donor Ctrl" means no ssODN was added to the sample.

DETAILED DESCRIPTION

Definitions

"Domain" as used herein is used to describe segments of a protein or nucleic acid. Unless otherwise indicated, a domain is not required to have any specific functional property.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Polypeptide" as used herein refers to a polymer of amino acids having less than 100 amino acid residues. In certain embodiments, it has less than 50, 20, or 10 amino acid residues.

"Alt-HDR," "alternative homology-directed repair," or "alternative HDR" as used herein refers to the process of repairing DNA damage using a homologous nucleic acid (e.g., an endogenous homologous sequence, e.g., a sister chromatid, or an exogenous nucleic acid, e.g., a template nucleic acid). Alt-HDR is distinct from canonical HDR in that the process utilizes different pathways from canonical HDR, and can be inhibited by the canonical HDR mediators, RAD51 and BRCA2. Also, alt-HDR uses a single-stranded or nicked homologous nucleic acid for repair of the break.

"Canonical HDR" or canonical homology-directed repair as used herein refers to the process of repairing DNA damage using a homologous nucleic acid (e.g., an endogenous homologous sequence, e.g., a sister chromatid, or an exogenous nucleic acid, e.g., a template nucleic acid). Canonical HDR typically acts when there has been significant resection at the double strand break, forming at least one single stranded portion of DNA. In a normal cell, HDR typically involves a series of steps such as recognition of the break, stabilization of the break, resection, stabilization of single stranded DNA, formation of a DNA crossover intermediate, resolution of the crossover intermediate, and ligation. The process requires RAD51 and BRCA2, and the homologous nucleic acid is typically double-stranded.

Unless indicated otherwise, the term "HDR" as used herein encompasses both canonical HDR and alt-HDR.

"Non-homologous end joining" or "NHEJ" as used herein refers to ligation mediated repair and/or non-template mediated repair including canonical NHEJ (cNHEJ), alternative NHEJ (altNHEJ), microhomology-mediated end joining (MMEJ), single-strand annealing (SSA), and synthesis-dependent microhomology-mediated end joining (SD-MMEJ).

A "reference molecule" as used herein refers to a molecule to which a modified or candidate molecule is compared. For example, a reference Cas9 molecule refers to a Cas9 molecule to which a modified or candidate Cas9 molecule is compared. Likewise, a reference gRNA refers to a gRNA molecule to which a modified or candidate gRNA molecule is compared. The modified or candidate molecule may be compared to the reference molecule on the basis of sequence (e.g., the modified or candidate molecule may have X % sequence identity or homology with the reference molecule) or activity (e.g., the modified or candidate molecule may have X % of the activity of the reference molecule). For example, where the reference molecule is a Cas9 molecule, a modified or candidate molecule may be characterized as having no more than 10% of the nuclease activity of the reference Cas9 molecule. Examples of reference Cas9 molecules include naturally occurring unmodified Cas9 molecules, e.g., a naturally occurring Cas9 molecule from *S. pyogenes, S. aureus, S. thermophilus*, or *N. meningitidis*. In certain embodiments, the reference Cas9 molecule is the naturally occurring Cas9 molecule having the closest sequence identity or homology with the modified or candidate Cas9 molecule to which it is being compared. In certain embodiments, the reference Cas9 molecule is a parental molecule having a naturally occurring or known sequence on which a mutation has been made to arrive at the modified or candidate Cas9 molecule.

"Replacement" or "replaced" as used herein with reference to a modification of a molecule does not require a process limitation but merely indicates that the replacement entity is present.

"Subject" as used herein may mean human, mouse, or non-human primate. In certain embodiments, the subject is a human, and in certain of these embodiments the human is an infant, child, young adult, or adult.

"Treat," "treating," and "treatment" as used herein mean the treatment of a disease in a subject, e.g., in a human, including (a) inhibiting the disease, i.e., arresting or preventing its development or progression; (b) relieving the disease, i.e., causing regression of the disease state; (c) relieving or preventing one or more symptoms of the disease; and (d) curing the disease. For example, "treating" AATD may refer to, but is not limited to, curing AATD, preventing or slowing development of AATD, relieving or preventing dyspnea, chronic cough, recurrent chest infections, chronic sputum production, or chronic wheeze, alleviating aggregation of A1AT in the liver, or restoring A1AT in blood circulation to a concentration of 11 μM.

"Prevent," "preventing," and "prevention" as used herein means the prevention of a disease in a subject, e.g., in a human, including (a) avoiding or precluding the disease; (b) affecting the predisposition toward the disease; and (c) delaying the onset of the disease or at least one symptom of the disease.

"X" as used herein in the context of an amino acid sequence refers to any amino acid (e.g., any of the twenty natural amino acids) unless otherwise specified.

"A1AT target position" as used herein refers to an A1AT target knockout position, an A1AT target knockin position, or an A1AT target point position as defined below. In certain embodiments of the methods, compositions, and kits provided herein, an A1AT target position is in the SERPINA1 coding region, e.g., an early coding region. In other embodiments, the target position is in the SERPINA1 non-coding region. In certain embodiments, the methods provided herein target multiple A1AT target positions for alteration simultaneously or sequentially.

"Target sequence" as used herein refers to a nucleic acid sequence comprising an A A1AT target position.

"A1AT target knockout position" as used herein refers to a position in the SERPINA1 gene which, when altered (e.g., by introduction of an NHEJ-mediated indel (e.g., insertion or deletion), results in reduction or elimination of expression of the gene product encoded by the SERPINA1 gene. In certain embodiments of the methods, compositions, and kits provided herein, an A1AT target knockout position is located in a SERPINA1 gene comprising one or more mutations, e.g., the S mutation and/or Z mutation.

"A1AT target knockin position" as used herein refers to a position in the SERPINA1 gene which, when altered by insertion (e.g., by introduction of an HDR-mediated insertion), results in an optimization, e.g., improvement, of an A1AT activity, e.g., by generating a sequence that encodes a protein having wild-type A1AT activity.

"A1AT target point position" as used herein refers to a position in the SERPINA1 gene, typically a single nucleotide, which, if mutated, can result in a protein having an amino acid substitution associated with A1AT deficiency. In certain embodiments, the A1AT target point position is a nucleotide or nucleotides that, when mutated, result in a substitution at E342, E264, or both in the expressed protein, e.g., an A1AT mutant protein having an E342K substitution, an E264V substitution, or both. In certain embodiments of the methods, compositions, and kits provide herein, an A1AT target point position is targeted for HDR-mediated sequence alteration in order to introduce a nucleotide or nucleotides corresponding to the wild-type nucleotide sequence.

A "Cas9 molecule" or "Cas9 polypeptide" as used herein refers to a molecule or polypeptide, respectively, that can interact with a gRNA molecule and, in concert with the gRNA molecule, localize to a site comprising a target domain and, in certain embodiments, a PAM sequence. Cas9 molecules and Cas9 polypeptides include both naturally occurring Cas9 molecules and Cas9 polypeptides and engineered, altered, or modified Cas9 molecules or Cas9 polypeptides that differ, e.g., by at least one amino acid residue, from a reference sequence, e.g., the most similar naturally occurring Cas9 molecule.

"Governing gRNA molecule" as used herein refers to a gRNA molecule that comprises a targeting domain complementary to a target domain on a nucleic acid that comprises a sequence that encodes a component of the CRISPR/RNA-guided nuclease system that is introduced into a cell or subject. A governing gRNA does not target an endogenous cell or subject sequence. In certain embodiments, a governing gRNA molecule comprises a targeting domain that is complementary with a target sequence on: (a) a nucleic acid that encodes an RNA-guided nuclease, e.g., a Cas9 molecule; (b) a nucleic acid that encodes a gRNA which comprises a targeting domain that targets the SERPINA1 or SERPINA1 gene (a target gene gRNA); or (c) on more than one nucleic acid that encodes a CRISPR/RNA-guided nuclease component, e.g., both (a) and (b). In an embodiment, a nucleic acid molecule that encodes a CRISPR/RNA-guided nuclease component, e.g., that encodes a Cas9 molecule or a target gene gRNA, comprises more than one target domain that is complementary with a governing gRNA targeting domain. While not wishing to be bound by theory, it is believed that a governing gRNA molecule complexes with a Cas9 molecule and results in Cas9 mediated inactivation of the targeted nucleic acid, e.g., by cleavage or by binding to the nucleic acid, and results in cessation or reduction of the production of a CRISPR/Cas system component. In an embodiment, the Cas9 molecule forms two complexes: a complex comprising a Cas9 molecule with a target gene gRNA, which complex will alter the SERPINA1 or SERPINA1 gene; and a complex comprising a Cas9 molecule with a governing gRNA molecule, which complex will act to prevent further production of a CRISPR/Cas system component, e.g., a Cas9 molecule or a target gene gRNA molecule. In an embodiment, a governing gRNA molecule/Cas9 molecule complex binds to or promotes cleavage of a control region sequence, e.g., a promoter, operably linked to a sequence that encodes a Cas9 molecule, a sequence that encodes a transcribed region, an exon, or an intron, for the Cas9 molecule. In an embodiment, a governing gRNA molecule/Cas9 molecule complex binds to or promotes cleavage of a control region sequence, e.g., a promoter, operably linked to a gRNA molecule, or a sequence that encodes the gRNA molecule. In an embodiment, the governing gRNA, e.g., a Cas9-targeting governing gRNA molecule, or a target gene gRNA-targeting governing gRNA molecule, limits the effect of the Cas9 molecule/target gene gRNA molecule complex-mediated gene targeting. In an embodiment, a governing gRNA places temporal, level of expression, or other limits, on activity of the Cas9 molecule/target gene gRNA molecule complex. In an embodiment, a governing gRNA reduces off-target or other unwanted activity. In an embodiment, a governing gRNA molecule inhibits, e.g., entirely or substantially entirely inhibits, the production of a component of the Cas9 system and thereby limits, or governs, its activity.

Alpha-1-Antitrypsin (A1AT) Deficiency

Alpha-1-antitrypsin (A1AT) deficiency is a genetic disease caused by defects in the SERPINA1 gene (also known as PI; A1A; AAT; PI1; A1AT; PRO2275; and alpha1AT). The nucleotide sequence of the SERPINA1 locus is set forth in SEQ ID NO:2231. The coding sequence of SERPINA1 is set forth in SEQ ID NO:251, and the amino acid sequence of the encoded A1AT protein product is set forth in SEQ ID NO:252.

In the United States, the prevalence of A1AT deficiency is between 1 in 5,000 and 1 in 7,000. A1AT deficiency is one of the most common genetic diseases in subjects of Northern European descent. Severe A1AT deficiency causes emphysema, with subjects developing emphysema in their third or fourth decade. A1AT deficiency can also cause liver failure and hepatocellular carcinoma, with up to 30% of subjects with severe A1AT deficiency developing significant liver disease, including cirrhosis, fulminant liver failure, and hepatocellular carcinoma.

There are two predominant mutations in the SERPINA1 gene that cause A1AT deficiency. These missense mutations affect protein conformation and secretion leading to reduced circulating levels of A1AT. The more common and more severe mutation is a glutamate to lysine substitution at amino acid position 342 (E342K, "Z mutation") of the mature A1AT protein, which can arise from, e.g., c.1024G>A (NT 13990 in SEQ ID NO:2231). Alleles carrying the Z mutation are identified as PiZ alleles. Subjects homozygous for the PiZ allele are termed PiZZ carriers, and express 10-15% of normal levels of serum A1AT. Approximately 95% of subjects who are symptomatic for A1AT deficiency have the PiZZ genotype. Subjects heterozygous for the Z mutation are termed PiMZ mutants, and express 60% of normal levels of serum A1AT. The other predominant mutation is a glutamate to valine substitution at position 264 (E264V, "S mutation") of the mature A1AT protein, which can arise from, e.g., c.791A>T (NT 11675 in SEQ ID NO:2231). Alleles with the S mutation are termed PiS. Subjects homozygous for the PiS allele are termed PiSS carriers, and express 60% of normal levels of serum A1AT. Subjects heterozygous for this mutation are termed PiMS and express 80% of normal levels of serum A1AT. Compound heterozygotes are represented as PiSZ. PiSZ subjects express 40% of normal levels of serum A1AT. Normal SERPINA1 subjects are represented as PiMM.

Between 30,000 and 50,000 individuals in the United States have the PiZZ genotype. The prevalence of any one of the five genotypic classes of A1AT mutations (PiZZ, PiMZ, PiSS, PiMS, and PiSZ) is approximately 1 in 5,000-7,000 in the United States. The prevalence is higher in Northern Europe, and may be as high as 1 in 1,500-3,000 in the Scandinavian population.

The pathophysiology of A1AT deficiency varies by the organ affected. Liver disease is due to a gain-of-function mechanism. Abnormally folded A1AT, especially Z-type A1AT (Z-AT), aggregates and polymerizes within hepatocytes. A1AT inclusions are found in PiZZ subjects and are thought to cause cirrhosis and, in some cases, hepatocellular carcinoma. Evidence for the gain-of-function mechanism in liver disease is supported by null homozygotes. These subjects produce no A1AT and do not develop hepatocyte inclusions or liver disease. Lung disease has been classically thought to be due to a loss-of-function mechanism: lower A1AT levels lead to unchecked activity of neutrophil elastase and subsequent alveolar destruction (Gadek et al. in The Metabolic Basis of Inherited Disease 1450-1457 (1982)). There is recent evidence that lung disease is also due in part to a gain-of-function mechanism. Z-type A1AT has been identified within the lung parenchyma and has been shown to be a neutrophil chemoattractant (Mulgrew 2004). Z-AAT may contribute through a toxic gain-of-function mechanism to inflammation and destruction of the lung parenchyma in A1AT deficiency (Alam 2014; Mornex 1986).

Less common manifestations of A1AT deficiency include membranoproliferative glomerular nephritis, rheumatoid arthritis, vascular disease including bleeding disorders, panniculitis, uveitis, and vasculitis.

A1AT deficiency leads to lung disease due to reduced inhibition of neutrophil elastase in the lung. A1AT enters the lung interstitium and alveolar lining fluid via passive diffusion from the plasma. Unchecked elastase activity in alveolae leads to destruction of the lung parenchyma. The primary manifestation of disease is emphysema with severe airflow obstruction. Subjects may also develop chronic bronchitis, bronchiectasis and asthma. Between 85 and 100% of subjects with the PiZZ genotype develop lung disease in their fourth or fifth decade. Other genotypes have a lower likelihood of developing lung disease and generally develop disease in their fifth decade or later. Smoking dramatically alters the phenotype in all A1AT deficient subjects. Smokers are more likely to develop disease and to experience earlier onset (generally 20 years earlier) and more severe disease. Lung disease in A1AT deficiency may additionally be due to monocyte and macrophage derived pathogenic Z-protein. Misfolded A1AT in PiZZ or PiSZ mutants is expressed by macrophages and has been demonstrated to be pro-inflammatory (Mulgrew 2004). The more severe lung phenotype of PiZZ and PiSZ genotypes may be due to the secretion of an altered protein in lung tissue by macrophages and monocytes (Alam 2014; Mornex 1986).

Lung disease associated with A1AT deficiency is currently treated with intravenous administration of human-derived replacement A1AT protein (Prolastin, Zemaira, or Aralast). The target A1AT blood level in plasma is greater than or equal to 570 micrograms per milliliter, which generally corresponds to a dose of 60 mg/kg weekly. A1AT replacement therapy can be used for the prevention of lung disease prior to definitive clinical demonstration of efficacy in delaying the onset and/or progression of disease, e.g., to reduce loss in lung density. Other treatment methods currently in use include, but are not limited to, bronchodilators, antibiotics to treat respiratory infections, and vaccination against pneumococcus and influenza. Inhaled corticosteroids and long-acting bronchodilators are also used in subjects with asthmatic symptoms or airflow obstruction. A treatment that prevents the progression of lung disease in A1AT deficiency without the need for monthly injections would be superior to the current standard of care. The inability of A1AT replacement therapy to fully prevent the development of lung disease may be due to the fact that replacement therapy does not eliminate the mutant Z-protein from being expressed by circulating monocytes and macrophages. Thus, a treatment that prevents damage to lung tissue that may occur due to the expression of the Z allele by circulating monocytes and macrophages would also be superior to the current standard of care.

A1AT deficiency leads to liver disease in up to 50% of A1AT subjects and leads to severe liver disease in up to 30% of subjects. Liver disease may manifest as: (a) cirrhosis during childhood that is self-limiting, (b) severe cirrhosis during childhood or adulthood that requires liver transplantation or leads to death and (c) hepatocellular carcinoma that is often deadly. The onset of liver disease is bi-modal, predominantly affecting children or adults. Childhood disease is self-limiting in many cases but may be lead to end-stage, deadly cirrhosis. Up to 18% of subjects with the PiZZ genotype may develop clinically significant liver abnormalities during childhood. Approximately 2% of PiZZ subjects develop severe liver cirrhosis leading to death during childhood (Sveger 1988; Volpert 2000). Adult-onset liver disease may affect subjects with all genotypes, but presents earlier in subjects with the PiZZ genotype. Approximately 2-10% of A1AT deficient subjects develop adult-onset liver disease.

Screening for hepatocellular carcinoma (HCC) includes, e.g., serial hepatic ultrasounds to monitor for the appearance liver nodules. Subjects who develop hepatocellular carcinoma can be treated with chemotherapy and surgery. Subjects who develop liver failure can be treated with a liver transplant. The development of liver disease in A1AT deficiency may be fatal in a large proportion of subjects: in one study, 40% of adult-onset liver disease subjects survived less than 2 years. A treatment that prevents the development of cirrhosis, liver failure, and hepatocellular carcinoma in subjects with A1AT deficiency would be vastly superior to the current standard of care.

Other potential therapies for treating A1AT deficiency include, but are not limited to, antisense oligonucleotide and RNA interference (RNAi), both of which aim to knock down the expression of Z protein. In animal models, RNAi has demonstrated sustained (weeks to months) knock-down of Z protein in PiZZ mutants. This approach requires repeated administration (monthly or every few months) of RNAi, often delivered via viral vector, for the lifetime of the subject in order to sustain knock down of the mutant Z protein. Repeated delivery of RNA to the liver with or without viral vector administration is associated with significant liver toxicity.

Overview

Provided herein are methods for treating or preventing A1AT deficiency, including A1AT deficiency caused by an E342K substitution ("Z mutation"), e.g., c.1024G>A in the SERPINA1 gene, or an E264V substitution ("S mutation"), e.g., c.791A>T in the SERPINA1 gene. These methods utilize CRISPR/Cas-mediated genome editing to alter (e.g., correct, knockin, or knockout) one or more target positions in the SERPINA1 gene. Also provided herein are compositions and kits for use in these methods. A1AT deficiency is associated with a variety of conditions, including lung diseases such as emphysema and liver diseases such as cirrhosis, liver failure, and hepatocellular carcinoma. Accordingly, further provided herein are methods, compositions, and kits for treating or preventing diseases of the lung (e.g., disorders that affect lung epithelium and/or lung parenchyma) and liver (e.g., disorders that affect hepatocytes), as well as diseases of monocytes and macrophages.

While not wishing to be bound by theory, it is believed that alteration of SERPINA1 in one or more of hepatocytes, lung epithelial cells, mononuclear phagocytes, alveolar macrophages, and myeloid precursor cells can prevent the progression of liver and lung disease in subjects with A1AT deficiency by reducing or eliminating production of the toxic Z protein (Z-AAT) or other AAT mutant proteins (e.g., S-AAT) in subjects with PiZZ, PiSZ, or other mutant A1AT alleles. Z protein misfolds within hepatocytes, lung epithelial cells, mononuclear phagocytes, alveolar macrophages, and myeloid precursor cells and the misfolded protein becomes trapped in the endoplasmic reticulum (ER), leading to ER stress and cell death via apoptosis. The presence of Z protein creates inflammation and a pro-inflammatory state in the liver and lung. In certain embodiments of the methods disclosed herein, Z protein production is eliminated or reduced by knocking out a mutant SERPINA1. In other embodiments, Z protein production is eliminated or reduced by correcting a SERPINA1 mutation or knocking in a corrected SERPINA1 sequence, resulting in production of wild-type A1AT (e.g., lung-protective A1AT). In certain embodiments, cells comprising a corrected or knocked-in SERPINA1 sequence do not undergo apoptosis, and in certain embodiments the altered cell does not cause inflammation. In certain embodiments, the disease is cured, does not progress, or has delayed progression compared to a subject who has not received the therapy.

In certain embodiments, the method described herein result in a selective advantage to survival of one or more of treated hepatocytes, lung epithelium, mononuclear phagocytes, alveolar macrophages, or myeloid precursor cells. In certain embodiments, the target cell is modified and has a SERPINA1 knockout or correction. Cells with a SERPINA1 knockout or correction do not produce toxic Z protein. Diseased cells that are not modified produce toxic Z protein and may undergo apoptosis secondary to endoplasmic reticulum (ER) stress induced by Z protein misfolding. Thus, in certain embodiments, after treatment using the methods described herein, treated cells survive, while untreated cells die. This selective advantage can drive eventual colonization in hepatocytes with 100% SERPINA1 corrected or knocked out cells. This selective advantage can also drive eventual colonization in lung epithelium, mononuclear phagocytes, alveolar macrophages and/or myeloid precursor cells with 0.100% SERPINA1 corrected or knocked out cells.

Approach 1A

In certain embodiments, methods are provided herein for treating or preventing A1AT deficiency in a PiZZ, PiSZ, or PiMZ subject, or any other subject with an A1AT mutation, using a CRISPR/RNA-guided nuclease (e.g., Cas9) system to knockin the correct nucleotide at or near a mutation in Exon V of the SERPINA1 gene (e.g., the Z mutation) using homology directed repair (HDR). These embodiments are referred to herein as "Approach 1A."

In certain embodiments, methods of Approach 1A comprise delivery of one or more (e.g., two, three, or four) gRNA molecules, an RNA-guided nuclease (e.g., a Cas9 molecule), and an HDR donor template, and in certain of these embodiments one or more of these components are delivered using one or more AAV vectors, nanoparticles, or a combination thereof. In certain embodiments, the donor template for HDR comprises a sequence including any or all of Exons II, III, IV, or V, or any or all of Exons III, IV, and V. In certain of these embodiments, the donor template further comprises a sequence comprising all or part of one or more intronic sequences between these exons. In certain embodiments, the donor template comprises a promoter sequence, while in other embodiments the template does not comprise a promoter. In certain embodiments, the donor template comprises a splice donor or acceptor. In certain embodiments, the donor template includes a polyadenylation signal.

In certain embodiments, one or more breaks (e.g., one or more single strand or double strand breaks) are introduced (e.g., positioned by one or more gRNA molecules) within 200 base pairs (bp) upstream and/or 200 bp downstream of one or more nucleotide mutations in the SERPINA1 gene (e.g., c.1024G>A), which results in expression of an A1AT mutant protein comprising an amino acid mutation at E342K. In certain embodiments, one or more of these breaks are in Exon V or in an intron adjacent to Exon V (either 5' or 3' of Exon V). In certain of these embodiments, one break is in Exon V and another break is in an intron adjacent to Exon V (either 5' or 3' of Exon V). In other embodiments, one break is in an intron 5' of Exon V and another break is in an intron 3' of Exon V. In certain embodiments, altering the A1AT target position results in HDR of genomic sequence including the mutation (e.g., c.1024G>A, resulting in expression of an A1AT mutant protein comprising amino acid mutation E342K), e.g., by a donor template sequence having a wild-type residue at the mutated position. In certain embodiments, this approach leads to cessation of production of Z-AAT and increased production of wild-type A1AT (M-AAT).

Methods of Approach 1A can prevent the development or progression of liver disease, in a subject due to cessation of Z-AAT production. This approach can also prevent the progression of lung disease by restoring the production of protective M-AAT. This approach may cure or prevent the progression of both liver and lung disease.

Approach 1B

In certain embodiments, methods are provided herein for treating or preventing A1AT deficiency in a PiZZ, PiSZ, or PiMZ subject, or any other subject with an A1AT mutation, using a CRISPR/RNA-guided nuclease (e.g., Cas9) system to knockout the Z allele by targeting Exon IV or V of the SERPINA1 gene. These embodiments are referred to herein as "Approach 1B."

In certain embodiments, methods of Approach 1B comprise delivery of one or more (e.g., two, three, or four) gRNA molecules and an RNA-guided nuclease (e.g., a Cas9 molecule), and in certain of these embodiments one or more of these components are delivered using one or more nanoparticles, AAV vectors, or a combination thereof.

In certain embodiments, one or more breaks (e.g., one or more double-strand breaks, one single-strand break, or a pair of single-strand breaks) are introduced (e.g., positioned by one or more gRNA molecules) at or in close proximity to an A1AT target position. In certain of these embodiments, the A1AT target position is within the coding sequence of Exon IV or V in the SERPINA1 gene. In certain embodiments, altering the A1AT target position results in deletion or insertion (e.g., mediated by NHEJ) at the A1AT target position (e.g., in Exon IV or V). In certain embodiments, this approach leads to cessation of production of Z-AAT.

Methods of Approach B provided herein can prevent the development or progression of liver disease in a subject due to cessation of Z-AAT production. This approach can also prevent the progression of at least some portion of lung disease in a subject.

Approach 2A

In certain embodiments, methods are provided herein for treating or preventing A1AT deficiency in a PiZZ, PiZnull (one PiZ allele, other allele missing), PiSZ, PiMZ, PiMS, or PiSS subject, or in any other subject with an A1AT mutation, using a CRISPR/RNA-guided nuclease (e.g., Cas9) system targeting an early coding region of SERPINA1 to knockout the Z allele, S allele, or other mutant A1AT alleles. These embodiments are referred to herein as "Approach 2A."

In certain embodiments, methods of Approach 2A comprise delivery of one or more (e.g., two, three, or four) gRNA molecules and an RNA-guided nuclease (e.g., a Cas9 molecule), and in certain of these embodiments one or more of these components are delivered using one or more nanoparticles, AAV vectors, or a combination thereof.

In certain embodiments, one or more breaks (e.g., one or more single strand or double strand breaks) are introduced (e.g., positioned by one or more gRNA molecules) at or in close proximity to an A1AT target position. In certain of these embodiments, the A1AT target position is at or near the start codon within Exon II in the SERPINA1 gene. In certain embodiments, altering the A1AT target position results in deletion or insertion (e.g., mediated by NHEJ) at the A1AT target position (e.g., Exon II, e.g., the start codon). In certain embodiments, this approach gives rise to the loss or destruction of the Z mutation, S mutation, or any mutation of the SERPINA1 gene. In certain embodiments, this approach leads to cessation of production of Z-AAT, S-AAT, or any mutant AAT in a cell comprising the modification.

Methods of Approach 2A provided herein can prevent the development or progression of liver disease in a subject due to the cessation of production of Z-AAT, S-AAT, or other mutant AAT protein. These methods can also prevent the progression of at least some portion of lung disease in a subject.

Approach 2B

In certain embodiments, methods are provided herein for treating or preventing A1AT deficiency in a PiZZ, PiZnull, PiSZ, PiMZ, PiMS, or PiSS subject, or any other subject with an A1AT mutation, using a CRISPR/RNA-guided nuclease (e.g., Cas9) system targeting the early coding region of SERPINA1 gene to knockout the Z allele, S allele, or other mutant SERPINA1 alleles in combination with expression of exogenous functional A1AT via delivery of a cDNA encoding A1AT driven by a constitutive or liver-specific promoter. These embodiments are referred to herein as "Approach 2B."

In certain embodiments, methods of Approach 2B comprise delivery of one or more (e.g., two, three, or four) gRNA molecules and an RNA-guided nuclease (e.g., a Cas9 molecule), and in certain of these embodiments one or more of these components are delivered using one or more nanoparticles, AAV vectors, or a combination thereof.

In certain embodiments, one or more breaks (e.g., one or more single strand or double strand breaks) are introduced (e.g., positioned by one or more gRNA molecules) at or in close proximity to an A1AT target position. In certain of these embodiments, the A1AT target position is at or near the start codon within Exon II in the SERPINA1 gene. In certain embodiments, altering the A1AT target position results in deletion or insertion (e.g., mediated by NHEJ) at the A1AT target position (e.g., Exon II, e.g., the start codon). In certain embodiments, this approach gives rise to the loss or destruction of the Z mutation, S mutation, or any mutation of the SERPINA1 gene. In certain embodiments, this approach leads to cessation of production of Z-AAT, S-AAT, or any mutant AAT in cells comprising the modification.

In certain embodiments, delivery of a cDNA coding for the SERPINA1 gene driven by a constitutive or liver-specific promoter leads to transcription of the donor SERPINA1 cDNA and translation of wild-type A1AT (M-AAT).

Methods of Approach 2B provided herein can prevent the development or progression of liver disease in a subject due to the cessation of production of Z-AAT, S-AAT, or other mutant AAT protein. These methods can also prevent the development or progression of lung disease in a subject due to the production of M-AAT. M-AAT levels can be maintained at endogenous levels, e.g., when they are driven by a liver-specific promoter.

The embodiments described herein may be used in all classes of vertebrates including, but not limited to, primates, mice, rats, rabbits, pigs, dogs, and cats.

Timing and Subject Selection

In certain embodiments of the methods provided herein, alteration of the SERPINA1 gene is initiated prior to disease onset, e.g., prior to developing symptoms or signs of lung or liver disease. In other embodiments, alteration of the SERPINA1 gene may be initiated after disease onset. In certain of these embodiments, alteration of the SERPINA1 gene is initiated in an early stage of disease, e.g., when a subject has tested positive for A1AT deficiency but has no signs or symptoms associated with A1AT deficiency. In other embodiments, alteration of the SERPINA1 gene is initiated after onset of A1AT deficiency. In certain of these embodiments, alteration of the SERPINA1 gene is initiated early in the course of disease progression (e.g., prior to the development of emphysema, cirrhosis, liver failure, and/or hepatocellular carcinoma), and in certain of these embodiments alteration of the SERPINA1 gene prevents or slows further progression of disease. In other embodiments, alteration of the SERPINA1 gene is initiated at an advanced stage of disease, and in certain of these embodiments alteration of the SERPINA1 gene slows, for example, progression of cirrhosis, progression of liver failure, or progression of decline in a lung function test (e.g., FEV1). Overall, initiation of treatment for a subject at all stages of disease is expected to prevent or reduce disease progression and benefit a subject.

In certain embodiments of the methods provided herein, alteration of the SERPINA1 gene is initiated in a subject who has undergone genetic testing which found a mutation in the SERPINA1 gene, e.g., a mutation described herein. In certain of these embodiments, alteration of the SERPINA1 gene is initiated in a subject who has been found to or was previously known to carry the PiZZ, PiSZ, PiSS, PiMZ, or PiMS allele, or another mutant A1AT allele. In certain embodiments, the methods provided herein comprise performing genetic testing on a subject, and initiating treatment if the subject is found to possess one or more mutations of the SERPINA1 gene.

In certain embodiments of the methods provided herein, alteration of the SERPINA1 gene is initiated in a subject who has exhibited an A1AT deficiency as demonstrated by, for example, low serum A1AT concentration and/or isoelectric focusing. In certain embodiments, the methods provided herein comprise testing a subject for A1AT deficiency, and initiating treatment if the subject exhibits A1AT deficiency.

In certain embodiments of the methods provided herein, alteration of the SERPINA1 gene is initiated in a subject with a family history of A1AT deficiency who demonstrates one or more symptoms or signs of the disease and/or has been found to have a mutation in the SERPINA1 gene. In certain of these embodiments, the methods comprise initiating treatment at the appearance of a reduced FEV1. In other embodiments, alteration of the SERPINA1 gene is initiated at the appearance of any of the following symptoms consistent or associated with A1AT deficiency: dyspnea, chronic cough, recurrent chest infections, chronic sputum production, or chronic wheeze.

In certain embodiments of the methods provided herein, alteration of the SERPINA1 gene is initiated at the appearance of any of the following findings consistent or associated with A1AT deficiency: decline in FEV1, emphysema, chronic obstructive pulmonary disease (COPD), asthma with airflow obstruction, necrotising panniculitis, elevation of transaminases or liver enzymes in liver function tests, cirrhosis, nodules found on hepatic ultrasound, hepatocellular carcinoma; CT, MRI or X-ray findings consistent with COPD including loss of lung density and/or emphysema; or CT findings of hepatic nodules or hepatocellular inclusions on liver biopsy.

In certain embodiments, the methods disclosed herein are performed on a one-time basis. In other embodiments, the methods utilize multi-dose therapy.

In certain embodiments, the SERPINA1 knockout methods described herein comprise introduction of one or more breaks near the early coding region in at least one allele of the SERPINA1 gene.

Repairing Mutation(s) in the SERPINA1 Gene

In certain embodiments, the methods provided herein (see, e.g., Approach 1A) comprise repairing (i.e., correcting) one or more mutations in the SERPINA1 gene, e.g., by HDR, using the CRISPR/RNA-guided nuclease (e.g., Cas9) system. In these methods, mutant SERPINA1 allele(s) are corrected and restored to wild-type state. While not wishing to be bound by theory, it is believed that correction of a mutation described herein in the SERPINA1 gene restores wild-type A1AT production. The method described herein can be performed in all cell types, e.g., a cell type described herein.

In certain embodiments, one SERPINA1 allele is repaired in the subject. In another embodiment, both SERPINA1 alleles are repaired in the subject. In either situation, the subject can be cured of disease. As the disease only displays a phenotype when both alleles are mutated, repair of a single allele is adequate for a cure.

In one aspect, methods and compositions discussed herein, provide for the correction of the underlying genetic cause of A1AT deficiency, e.g., the correction of a mutation at a target position in the SERPINA1 gene, e.g., correction of a mutation described herein in the SERPINA1 gene.

In certain embodiments, the method provides for the correction of a mutation at a target position in the SERPINA1 gene, e.g., correction of a mutation described herein in the SERPINA1 gene. As described herein, in one embodiment, the method comprises the introduction of one or more breaks (e.g., single strand breaks or double strand breaks) sufficiently close to (e.g., either 5' or 3' to) the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V.

In certain embodiments, the targeting domain of the gRNA molecule is configured to provide a cleavage event, e.g., a double strand break or a single strand break, sufficiently close to (e.g., either 5' or 3' to) the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V, to allow correction, e.g., an alteration in the SERPINA1 gene, e.g., an alteration associated with HDR. In certain embodiments, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V. The break, e.g., a double strand or single strand break, can be positioned upstream or downstream of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V. In certain embodiments, the break is positioned upstream or downstream of the target position in the SERPINA1 gene, e.g., in Exon V or an intron adjacent to Exon V (e.g., either 5' or 3' of Exon V).

In certain embodiments, a second, third and/or fourth gRNA molecule is configured to provide a cleavage event, e.g., a double strand break or a single strand break, sufficiently close to (e.g., either 5' or 3' to) the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V, to allow correction, e.g., an alteration associated with HDR in the SERPINA1 gene. In certain embodiments, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V. The break, e.g., a double strand or single strand break, can be positioned upstream or downstream of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V. In certain embodiments, the break is positioned upstream or downstream of the target position in the SERPINA1 gene, e.g., in Exon V or an intron adjacent to Exon V (e.g., either 5' or 3' of Exon V).

In certain embodiments, a single strand break is accompanied by an additional single strand break, positioned by a second, third and/or fourth gRNA molecule, as discussed below. For example, the targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V. In certain embodiments, the first and second gRNA molecules are configured such that, when guiding a Cas9 nickase, a single strand break will be accompanied by an additional single strand break, positioned by a second gRNA, sufficiently close to one another to result in an alteration of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V. In certain embodiments, the first and second gRNA molecules are configured such that a single strand break positioned by said second gRNA is within 10, 20, 30, 40, 50, 100, 200, 300, 400, 500, 600, 700, 800, 900, or 1000 nucleotides of the break positioned by said first gRNA molecule, e.g., when the Cas9 is a nickase. In certain embodiments, the two gRNA molecules are configured to position cuts at the same position, or within a few nucleotides of one another, on different strands, e.g., essentially mimicking a double strand break. In certain embodiments, the break is positioned upstream or downstream of the target position in the SERPINA1 gene, e.g., in Exon V or an intron adjacent to Exon V (e.g., either 5' or 3' of Exon V).

In certain embodiments, a double strand break can be accompanied by an additional double strand break, positioned by a second, third and/or fourth gRNA molecule, as is discussed below. For example, the targeting domain of a first gRNA molecule is configured such that a double strand break is positioned upstream of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position; and the targeting domain of a second gRNA molecule is configured such that a double strand break is positioned downstream the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position. In certain embodiments, the break is positioned upstream or downstream of the target position in the SERPINA1 gene, e.g., in Exon V or an intron adjacent to Exon V (e.g., either 5' or 3' of Exon V).

In certain embodiments, a double strand break can be accompanied by two additional single strand breaks, positioned by a second gRNA molecule and a third gRNA molecule. For example, the targeting domain of a first gRNA molecule is configured such that a double strand break is positioned upstream of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position; and the targeting domains of a second and third gRNA molecule are configured such that two single strand breaks are positioned downstream of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position. In certain embodiments, the targeting domain of the first, second and third gRNA molecules are configured such that a cleavage event, e.g., a double strand or single strand break, is positioned, independently for each of the gRNA molecules. In certain embodiments, the break is positioned upstream or downstream of the target position in the SERPINA1 gene, e.g., in Exon V or an intron adjacent to Exon V (e.g., either 5' or 3' of Exon V).

In certain embodiments, first and second single strand breaks can be accompanied by two additional single strand breaks positioned by a third gRNA molecule and a fourth gRNA molecule. For example, the targeting domain of a first and second gRNA molecule are configured such that two single strand breaks are positioned upstream of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V; and the targeting domains of a third and fourth gRNA molecule are configured such that two single strand breaks are positioned downstream of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the SERPINA1 gene, e.g., one or more nucleotide mutations in the SERPINA1 gene (e.g., a mutation at c.1024 or c.791 in the SERPINA1 gene), which results in expression of an A1AT mutant protein comprising E342K or E264V. In certain embodiments, the break is positioned upstream or downstream of the target position in the SERPINA1 gene, e.g., in Exon V or an intron adjacent to Exon V (e.g., either 5' or 3' of Exon V).

NHEJ-Mediated Introduction of an Indel in Close Proximity to or within the Early Coding Region of the A1AT Deficiency Knockout Position In certain embodiments, the methods disclosed herein (see, e.g., Approaches 2A and 2B) comprise knocking out the SERPINA1 gene to treat or prevent A1AT deficiency. In certain of these embodiments, knockout of the SERPINA1 gene is accomplished by insertion or deletion (e.g., NHEJ-mediated insertion or deletion) of one or more nucleotides in close proximity to or within the early coding region of the SERPINA1 gene. As described herein, in certain embodiments, the methods comprise introduction of one or more breaks (e.g., single strand breaks or double strand breaks) sufficiently close to (e.g., either 5' or 3' to) the early coding region of the A1AT target knockout position, such that the break-induced indel could be reasonably expected to span the A1AT target knockout position (e.g., the early coding region). While not wishing to be bound by theory, it is believed that NHEJ-mediated repair of the break(s) allows for the NHEJ-mediated introduction of an indel in close proximity to within the early coding region of the A1AT target knockout position.

In certain embodiments, the targeting domain of a first gRNA molecule is configured to provide a cleavage event, e.g., a double strand break or a single strand break, sufficiently close to the early coding region in the SERPINA1 gene to allow alteration, e.g., alteration associated with NHEJ in the SERPINA1 gene. In certain embodiments, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 250, 300, 350, 400, 450, or 500 nucleotides of an A1AT target knockout position. The break, e.g., a double strand or single strand break, can be positioned upstream or downstream of an A1AT target knockout position in the SERPINA1 gene.

In certain embodiments, a second gRNA molecule comprising a second targeting domain is configured to provide a cleavage event, e.g., a double strand break or a single strand break, sufficiently close to the early coding region in the SERPINA1 gene, to allow alteration, e.g., alteration associated with NHEJ in the SERPINA1 gene, either alone or in combination with the break positioned by said first gRNA molecule. In certain embodiments, the targeting domains of the first and second gRNA molecules are configured such that a cleavage event, e.g., a double strand or single strand break, is positioned, independently for each of the gRNA molecules, within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position. In certain embodiments, the breaks, e.g., double strand or single strand breaks, are positioned on either side of a nucleotide of an A1AT target knockout position in the SERPINA1 gene. In other embodiments, the breaks, e.g., double strand or single strand breaks, are both positioned on one side, e.g., upstream or downstream, of a nucleotide of a A1AT target knockout position in the SERPINA1 gene.

In certain embodiments, a single strand break is accompanied by an additional single strand break, positioned by a second gRNA molecule, as discussed below. For example, the targeting domains may be configured such that a cleavage event, e.g., two single strand breaks, is positioned within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the early coding region in the SERPINA1 gene. In certain embodiments, the first and second gRNA molecules are configured such that, when guiding a Cas9 nickase, a single strand break will be accompanied by an additional single strand break, positioned by a second gRNA, sufficiently close to one another to result in alteration of the early coding region in the SERPINA1 gene. In certain embodiments, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In certain embodiments, the two gRNA molecules are configured to position cuts at the same position, or within a few nucleotides of one another, on different strands, e.g., essentially mimicking a double strand break.

In certain embodiments, a double strand break can be accompanied by an additional double strand break, positioned by a second gRNA molecule, as is discussed below. For example, the targeting domain of a first gRNA molecule is configured such that a double strand break is positioned upstream of the early coding region in the SERPINA1 gene, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position; and the targeting domain of a second gRNA molecule is configured such that a double strand break is positioned downstream of the early coding region in the SERPINA1 gene, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position.

In certain embodiments, a double strand break can be accompanied by two additional single strand breaks, positioned by a second gRNA molecule and a third gRNA molecule. For example, the targeting domain of a first gRNA molecule is configured such that a double strand break is positioned upstream of the early coding region in the SERPINA1 gene, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position; and the targeting domains of a second and third gRNA molecule are configured such that two single strand breaks are positioned downstream of the early coding region in the SERPINA1 gene, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position. In certain embodiments, the targeting domains of the first, second and third gRNA molecules are configured such that a cleavage event, e.g., a double strand or single strand break, is positioned, independently for each of the gRNA molecules.

In certain embodiments, a first and second single strand break can be accompanied by two additional single strand breaks positioned by a third and fourth gRNA molecule. For example, the targeting domains of a first and second gRNA molecule are configured such that two single strand breaks are positioned upstream of the early coding region in the SERPINA1 gene, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the early coding region in the SERPINA1 gene; and the targeting domains of a third and fourth gRNA molecule are configured such that two single strand breaks are positioned downstream of a A1AT target knockout position in the early coding region in the SERPINA1 gene, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the early coding region in the SERPINA1 gene.

NHEJ-Mediated Deletion of at Least a Portion of the SERPINA1 Gene at the A1AT Target Position In certain embodiments, the methods disclosed herein (see, e.g., Approach 1B) comprise knocking out the SER- PINA1 gene to treat or prevent A1AT deficiency. In certain of these embodiments, knockout of the SERPINA1 gene is accomplished by deletion (e.g., NHEJ-mediated deletion) of a genomic sequence including at least a portion of the SERPINA1 gene, wherein said portion of the SERPINA1 gene includes a mutation, e.g., a mutation described herein, e.g., a Z mutation. In certain embodiments, the method comprises the introduction of two double strand breaks-one 5' and the other 3' to (i.e., flanking) the A1AT target position (e.g., a mutation in the SERPINA1 gene). Two gRNAs, e.g., unimolecular (or chimeric) or modular gRNA molecules, are configured to position the two double strand breaks on opposite sides of the A1AT target knockout position (e.g., at least a portion of Exon IV, Exon V, or both that includes a mutation) in the SERPINA1 gene. In certain embodiments, the first double strand break is positioned upstream of the mutation, and the second double strand break is positioned downstream of the mutation. In certain embodiments, the two double strand breaks are positioned to remove a portion of Exon IV, Exon V, or both. In certain embodiments, the breaks (i.e., the two double strand breaks) are positioned to avoid unwanted target chromosome elements, such as repeat elements, e.g., an Alu repeat, or the endogenous splice sites.

While not wishing to be bound by theory, it is believed that the two double strand breaks allow for NHEJ-mediated deletion of a least a portion of the SERPINA1 gene that contains the mutation.

In certain embodiments, the method comprises introducing a NHEJ-mediated deletion of a genomic sequence including a mutation in the SERPINA1 gene, e.g., a mutation described herein. As described herein, in one embodiment, the method comprises the introduction of two sets of breaks (e.g., one double strand break and a pair of single strand breaks)—one 5' and the other 3' to (i.e., flanking) the A1AT target position (e.g., at least a portion of Exon IV, Exon V, or both that includes a mutation). Two gRNAs, e.g., unimolecular (or chimeric) or modular gRNA molecules, are configured to position the two sets of breaks (either the double strand break or the pair of single strand breaks) on opposite sides of the A1AT target position in the SERPINA1 gene. In certain embodiments, the breaks (i.e., the two sets of breaks (either the double strand break or the pair of single strand breaks)) are positioned to avoid unwanted target chromosome elements, such as repeat elements, e.g., an Alu repeat, or the endogenous splice sites.

While not wishing to be bound by theory, it is believed that the two sets of breaks (e.g., one double strand break and a pair of single strand breaks) allow for NHEJ-mediated deletion of a least a portion of the SERPINA1 gene that contains the mutation.

In certain embodiments, the method comprises introducing a NHEJ-mediated deletion of a genomic sequence including a mutation in the SERPINA1 gene, e.g., a mutation described herein. As described herein, in one embodiment, the method comprises the introduction of two sets of breaks (e.g., two pairs of single strand breaks)—one 5' and the other 3' to (i.e., flanking) the A1AT target position (e.g., at least a portion of Exon IV, Exon V, or both that includes a mutation). Two gRNAs, e.g., unimolecular (or chimeric) or modular gRNA molecules, are configured to position the two sets of breaks on opposite sides of the A1AT target knockout position in the SERPINA1 gene. In certain embodiments, the breaks (i.e., the two pairs of single strand breaks) are positioned to avoid unwanted target chromosome elements, such as repeat elements, e.g., an Alu repeat, or the endogenous splice sites.

While not wishing to be bound by theory, it is believed that the two sets of breaks (e.g., the two pair of single strand breaks) allow for NHEJ-mediated deletion of a least a portion of the SERPINA1 gene that contains the mutation.

Guide RNA (gRNA) Molecules

A gRNA molecule, as that term is used herein, refers to a nucleic acid that promotes the specific targeting or homing of a gRNA molecule/RNA-guided nuclease (e.g., Cas9 molecule) complex to a target nucleic acid. gRNA molecules can be unimolecular (having a single RNA molecule), sometimes referred to herein as "chimeric" gRNAs, or modular (comprising more than one, and typically two, separate RNA molecules). The gRNA molecules provided herein comprise a targeting domain comprising, consisting of, or consisting essentially of a nucleic acid sequence fully or partially complementary to a target nucleic acid sequence in or near the SERPINA1 gene. In certain embodiments, the gRNA molecule further comprises one or more additional domains, including for example a first complementarity domain, a linking domain, a second complementarity domain, a proximal domain, a tail domain, and a 5' extension domain. Each of these domains is discussed in detail below. In certain embodiments, one or more of the domains in the gRNA molecule comprises a nucleotide sequence identical to or sharing sequence homology with a naturally occurring sequence, e.g., from *S. pyogenes*, *S. aureus*, or *S. thermophilus*.

Figure 7:
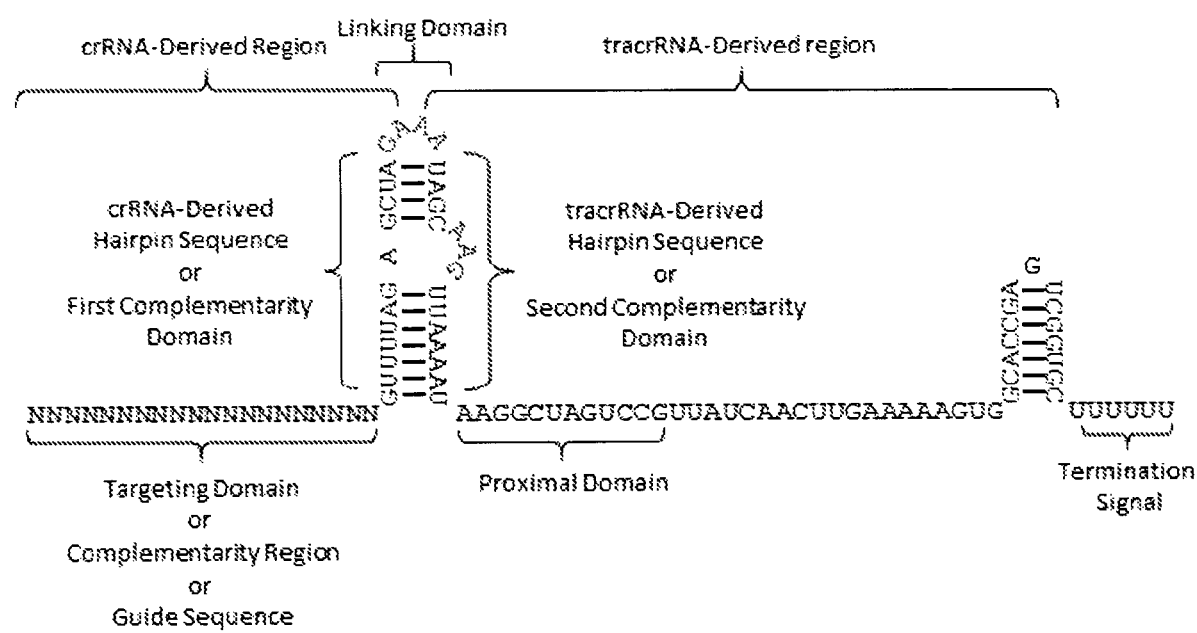
FIG. 7 illustrates gRNA domain nomenclature using an exemplary gRNA sequence (SEQ ID NO:42).

Several exemplary gRNA structures are provided in FIGS. 1A-1I. With regard to the three-dimensional form, or intra- or inter-strand interactions of an active form of a gRNA, regions of high complementarity are sometimes shown as duplexes in FIGS. 1A-1I and other depictions provided herein. FIG. 7 illustrates gRNA domain nomenclature using the gRNA sequence of SEQ ID NO:42, which contains one hairpin loop in the tracrRNA-derived region. In certain embodiments, a gRNA may contain more than one (e.g., two, three, or more) hairpin loops in this region (see, e.g., FIGS. 1H-1I).

In certain embodiments, a unimolecular, or chimeric, gRNA comprises, preferably from 5' to 3':
  a targeting domain complementary to a target domain in the SERPINA1 gene, e.g., a targeting domain from any of SEQ ID NOs:253-2192;
  a first complementarity domain;
  a linking domain;
  a second complementarity domain (which is complementary to the first complementarity domain);
  a proximal domain; and optionally, a tail domain.

In certain embodiments, a modular gRNA comprises:
  a first strand comprising, preferably from 5' to 3':
    a targeting domain complementary to a target domain in the SERPINA1 gene, e.g., a targeting domain from any of SEQ ID NOs:253-2192; and
    a first complementarity domain; and
  a second strand, comprising, preferably from 5' to 3':
    optionally, a 5' extension domain;
    a second complementarity domain;
    a proximal domain; and
    optionally, a tail domain.

Targeting Domain

The targeting domain (sometimes referred to alternatively as the guide sequence or complementarity region) comprises, consists of, or consists essentially of a nucleic acid sequence that is complementary or partially complementary to a nucleic acid sequence in or near the SERPINA1 gene. The nucleic acid sequence in or near the SERPINA1 gene to which all or a portion of the targeting domain is complementary or partially complementary is referred to herein as the target domain. In certain embodiments, the target domain comprises an A1AT target position. In other embodiments, an A1AT target position lies outside (i.e., upstream or downstream of) the target domain.

Methods for selecting targeting domains are known in the art (see, e.g., Fu 2014; Sternberg 2014). Examples of suitable targeting domains for use in the methods, compositions, and kits described herein include those set forth in SEQ ID NOs:253-2192.

The strand of the target nucleic acid comprising the target domain is referred to herein as the complementary strand because it is complementary to the targeting domain sequence. Since the targeting domain is part of a gRNA molecule, it comprises the base uracil (U) rather than thymine (T); conversely, any DNA molecule encoding the gRNA molecule will comprise thymine rather than uracil. In a targeting domain/target domain pair, the uracil bases in the targeting domain will pair with the adenine bases in the target domain. In certain embodiments, the degree of complementarity between the targeting domain and target domain is sufficient to allow targeting of an RNA-guided nuclease (e.g., a Cas9 molecule) to the target nucleic acid.

In certain embodiments, the targeting domain comprises a core domain and an optional secondary domain. In certain of these embodiments, the core domain is located 3' to the secondary domain, and in certain of these embodiments the core domain is located at or near the 3' end of the targeting domain. In certain of these embodiments, the core domain consists of or consists essentially of about 8 to about 13 nucleotides at the 3' end of the targeting domain. In certain embodiments, only the core domain is complementary or partially complementary to the corresponding portion of the target domain, and in certain of these embodiments the core domain is fully complementary to the corresponding portion of the target domain. In other embodiments, the secondary domain is also complementary or partially complementary to a portion of the target domain. In certain embodiments, the core domain is complementary or partially complementary to a core domain target in the target domain, while the secondary domain is complementary or partially complementary to a secondary domain target in the target domain. In certain embodiments, the core domain and secondary domain have the same degree of complementarity with their respective corresponding portions of the target domain. In other embodiments, the degree of complementarity between the core domain and its target and the degree of complementarity between the secondary domain and its target may differ. In certain of these embodiments, the core domain may have a higher degree of complementarity for its target than the secondary domain, whereas in other embodiments the secondary domain may have a higher degree of complementarity than the core domain.

In certain embodiments, the targeting domain and/or the core domain within the targeting domain is 3 to 100, 5 to 100, 10 to 100, or 20 to 100 nucleotides in length, and in certain of these embodiments the targeting domain or core domain is 3 to 15, 3 to 20, 5 to 20, 10 to 20, 15 to 20, 5 to 50, 10 to 50, or 20 to 50 nucleotides in length. In certain embodiments, the targeting domain and/or the core domain within the targeting domain is 6, 7, 8, 9, 10, 11, 12, 13, 14, 15, 16, 17, 18, 19, 20, 21, 22, 23, 24, 25, or 26 nucleotides in length. In certain embodiments, the targeting domain and/or the core domain within the targeting domain is 6+/−2, 7+/−2, 8+/−2, 9+/−2, 10+/−2, 10+/−4, 10+/−5, 11+/−2, 12+/−2, 13+/−2, 14+/−2, 15+/−2, or 16+/−2, 20+/−5, 30+/−5, 40+/−5, 50+/−5, 60+/−5, 70+/−5, 80+/−5, 90+/−5, or 100+/−5 nucleotides in length.

In certain embodiments wherein the targeting domain includes a core domain, the core domain is 3 to 20 nucleotides in length, and in certain of these embodiments the core domain 5 to 15 or 8 to 13 nucleotides in length. In certain embodiments wherein the targeting domain includes a secondary domain, the secondary domain is 0, 1, 2, 3, 4, 5, 6, 7, 8, 9, 10, 11, 12, 13, 14 or 15 nucleotides in length. In certain embodiments wherein the targeting domain comprises a core domain that is 8 to 13 nucleotides in length, the targeting domain is 26, 25, 24, 23, 22, 21, 20, 19, 18, 17, or 16 nucleotides in length, and the secondary domain is 13 to 18, 12 to 17, 11 to 16, 10 to 15, 9 to 14, 8 to 13, 7 to 12, 6 to 11, 5 to 10, 4 to 9, or 3 to 8 nucleotides in length, respectively.

In certain embodiments, the targeting domain is fully complementary to the target domain. Likewise, where the targeting domain comprises a core domain and/or a secondary domain, in certain embodiments one or both of the core domain and the secondary domain are fully complementary to the corresponding portions of the target domain. In other embodiments, the targeting domain is partially complementary to the target domain, and in certain of these embodiments where the targeting domain comprises a core domain and/or a secondary domain, one or both of the core domain and the secondary domain are partially complementary to the corresponding portions of the target domain. In certain of these embodiments, the nucleic acid sequence of the targeting domain, or the core domain or targeting domain within the targeting domain, is at least 80, 85, 90, or 95% complementary to the target domain or to the corresponding portion of the target domain. In certain embodiments, the targeting domain and/or the core or secondary domains within the targeting domain include one or more nucleotides that are not complementary with the target domain or a portion thereof, and in certain of these embodiments the targeting domain and/or the core or secondary domains within the targeting domain include 1, 2, 3, 4, 5, 6, 7, or 8 nucleotides that are not complementary with the target domain. In certain embodiments, the core domain includes 1, 2, 3, 4, or 5 nucleotides that are not complementary with the corresponding portion of the target domain. In certain embodiments wherein the targeting domain includes one or more nucleotides that are not complementary with the target domain, one or more of said non-complementary nucleotides are located within five nucleotides of the 5' or 3' end of the targeting domain. In certain of these embodiments, the targeting domain includes 1, 2, 3, 4, or 5 nucleotides within five nucleotides of its 5' end, 3' end, or both its 5' and 3' ends that are not complementary to the target domain. In certain embodiments wherein the targeting domain includes two or more nucleotides that are not complementary to the target domain, two or more of said non-complementary nucleotides are adjacent to one another, and in certain of these embodiments the two or more consecutive non-complementary nucleotides are located within five nucleotides of the 5' or 3' end of the targeting domain. In other embodiments, the two or more consecutive non-complementary nucleotides are both located more than five nucleotides from the 5' and 3' ends of the targeting domain.

In certain embodiments, the targeting domain, core domain, and/or secondary domain do not comprise any modifications. In other embodiments, the targeting domain, core domain, and/or secondary domain, or one or more nucleotides therein, have a modification, including but not limited to the modifications set forth below. In certain embodiments, one or more nucleotides of the targeting domain, core domain, and/or secondary domain may comprise a 2' modification (e.g., a modification at the 2' position on ribose), e.g., a 2-acetylation, e.g., a 2' methylation. In certain embodiments, the backbone of the targeting domain can be modified with a phosphorothioate. In certain embodiments, modifications to one or more nucleotides of the targeting domain, core domain, and/or secondary domain render the targeting domain and/or the gRNA comprising the targeting domain less susceptible to degradation or more bio-compatible, e.g., less immunogenic. In certain embodiments, the targeting domain and/or the core or secondary domains include 1, 2, 3, 4, 5, 6, 7, or 8 or more modifications, and in certain of these embodiments the targeting domain and/or core or secondary domains include 1, 2, 3, or 4 modifications within five nucleotides of their respective 5' ends and/or 1, 2, 3, or 4 modifications within five nucleotides of their respective 3' ends. In certain embodiments, the targeting domain and/or the core or secondary domains comprise modifications at two or more consecutive nucleotides.

In certain embodiments wherein the targeting domain includes core and secondary domains, the core and secondary domains contain the same number of modifications. In certain of these embodiments, both domains are free of modifications. In other embodiments, the core domain includes more modifications than the secondary domain, or vice versa.

In certain embodiments, modifications to one or more nucleotides in the targeting domain, including in the core or secondary domains, are selected to not interfere with targeting efficacy, which can be evaluated by testing a candidate modification using a system as set forth below. gRNAs having a candidate targeting domain having a selected length, sequence, degree of complementarity, or degree of modification can be evaluated using a system as set forth below. The candidate targeting domain can be placed, either alone or with one or more other candidate changes in a gRNA molecule/RNA-guided nuclease (e.g., Cas9 molecule) system known to be functional with a selected target, and evaluated.

In certain embodiments, all of the modified nucleotides are complementary to and capable of hybridizing to corresponding nucleotides present in the target domain. In another embodiment, 1, 2, 3, 4, 5, 6, 7, or 8 or more modified nucleotides are not complementary to or capable of hybridizing to corresponding nucleotides present in the target domain.

FIGS. 1A-1I provide examples of the placement of the targeting domain within a gRNA molecule.

First and Second Complementarity Domains

The first and second complementarity (sometimes referred to alternatively as the crRNA-derived hairpin sequence and tracrRNA-derived hairpin sequences, respectively) domains are fully or partially complementary to one another. In certain embodiments, the degree of complementarity is sufficient for the two domains to form a duplexed region under at least some physiological conditions. In certain embodiments, the degree of complementarity between the first and second complementarity domains, together with other properties of the gRNA, is sufficient to allow targeting of an RNA-guided nuclease (e.g., a Cas9 molecule) to a target nucleic acid. Examples of first and second complementarity domains are set forth in FIGS. 1A-1G.

In certain embodiments (see, e.g., FIGS. 1A-1B) the first and/or second complementarity domain includes one or more nucleotides that lack complementarity with the corresponding complementarity domain. In certain embodiments, the first and/or second complementarity domain includes 1, 2, 3, 4, 5, or 6 nucleotides that do not complement with the corresponding complementarity domain. For example, the second complementarity domain may contain 1, 2, 3, 4, 5, or 6 nucleotides that do not pair with corresponding nucleotides in the first complementarity domain. In certain embodiments, the nucleotides on, the first or second complementarity domain that do not complement with the corresponding complementarity domain loop out from the duplex formed between the first and second complementarity domains. In certain of these embodiments, the unpaired loop-out is located on the second complementarity domain, and in certain of these embodiments the unpaired region begins 1, 2, 3, 4, 5, or 6 nucleotides from the 5' end of the second complementarity domain.

In certain embodiments, the first complementarity domain is 5 to 30, 5 to 25, 7 to 25, 5 to 24, 5 to 23, 7 to 22, 5 to 22, 5 to 21, 5 to 20, 7 to 18, 7 to 15, 9 to 16, or 10 to 14 nucleotides in length, and in certain of these embodiments the first complementarity domain is 5, 6, 7, 8, 9, 10, 11, 12, 13, 14, 15, 16, 17, 18, 19, 20, 21, 22, 23, 24, or 25 nucleotides in length. In certain embodiments, the second complementarity domain is 5 to 27, 7 to 27, 7 to 25, 5 to 24, 5 to 23, 5 to 22, 5 to 21, 7 to 20, 5 to 20, 7 to 18, 7 to 17, 9 to 16, or 10 to 14 nucleotides in length, and in certain of these embodiments the second complementarity domain is 5, 6, 7, 8, 9, 10, 11, 12, 13, 14, 15, 16, 17, 18, 19, 20, 21, 22, 23, 24, 25, or 26 nucleotides in length. In certain embodiments, the first and second complementarity domains are each independently 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length. In certain embodiments, the second complementarity domain is longer than the first complementarity domain, e.g., 2, 3, 4, 5, or 6 nucleotides longer.

In certain embodiments, the first and/or second complementarity domains each independently comprise three subdomains, which, in the 5' to 3' direction are: a 5' subdomain, a central subdomain, and a 3' subdomain. In certain embodiments, the 5' subdomain and 3' subdomain of the first complementarity domain are fully or partially complementary to the 3' subdomain and 5' subdomain, respectively, of the second complementarity domain.

In certain embodiments, the 5' subdomain of the first complementarity domain is 4 to 9 nucleotides in length, and in certain of these embodiments the 5' domain is 4, 5, 6, 7, 8, or 9 nucleotides in length. In certain embodiments, the 5' subdomain of the second complementarity domain is 3 to 25, 4 to 22, 4 to 18, or 4 to 10 nucleotides in length, and in certain of these embodiments the 5' domain is 3, 4, 5, 6, 7, 8, 9, 10, 11, 12, 13, 14, 15, 16, 17, 18, 19, 20, 21, 22, 23, 24, or 25 nucleotides in length. In certain embodiments, the central subdomain of the first complementarity domain is 1, 2, or 3 nucleotides in length. In certain embodiments, the central subdomain of the second complementarity domain is 1, 2, 3, 4, or 5 nucleotides in length. In certain embodiments, the 3' subdomain of the first complementarity domain is 3 to 25, 4 to 22, 4 to 18, or 4 to 10 nucleotides in length, and in certain of these embodiments the 3' subdomain is 3, 4, 5, 6, 7, 8, 9, 10, 11, 12, 13, 14, 15, 16, 17, 18, 19, 20, 21, 22, 23, 24, or 25 nucleotides in length. In certain embodiments, the 3' subdomain of the second complementarity domain is 4 to 9, e.g., 4, 5, 6, 7, 8, or 9 nucleotides in length.

The first and/or second complementarity domains can share homology with, or be derived from, naturally occurring or reference first and/or second complementarity domains. In certain of these embodiments, the first and/or second complementarity domains have at least 50%, 60%, 70%, 80%, 85%, 90%, or 95% homology with, or differ by no more than 1, 2, 3, 4, 5, or 6 nucleotides from, the naturally occurring or reference first and/or second complementarity domain. In certain of these embodiments, the first and/or second complementarity domains may have at least 50%, 60%, 70%, 80%, 85%, 90%, or 95% homology with homology with a first and/or second complementarity domain from S. pyogenes or S. aureus.

In certain embodiments, the first and/or second complementarity domains do not comprise any modifications. In other embodiments, the first and/or second complementarity domains or one or more nucleotides therein have a modification, including but not limited to a modification set forth below. In certain embodiments, one or more nucleotides of the first and/or second complementarity domain may comprise a 2' modification (e.g., a modification at the 2' position on ribose), e.g., a 2-acetylation, e.g., a 2' methylation. In certain embodiments, the backbone of the targeting domain can be modified with a phosphorothioate. In certain embodiments, modifications to one or more nucleotides of the first and/or second complementarity domain render the first and/or second complementarity domain and/or the gRNA comprising the first and/or second complementarity less susceptible to degradation or more bio-compatible, e.g., less immunogenic. In certain embodiments, the first and/or second complementarity domains each independently include 1, 2, 3, 4, 5, 6, 7, or 8 or more modifications, and in certain of these embodiments the first and/or second complementarity domains each independently include 1, 2, 3, or 4 modifications within five nucleotides of their respective 5' ends, 3' ends, or both their 5' and 3' ends. In other embodiments, the first and/or second complementarity domains each independently contain no modifications within five nucleotides of their respective 5' ends, 3' ends, or both their 5' and 3' ends. In certain embodiments, one or both of the first and second complementarity domains comprise modifications at two or more consecutive nucleotides.

In certain embodiments, modifications to one or more nucleotides in the first and/or second complementarity domains are selected to not interfere with targeting efficacy, which 1 can be evaluated by testing a candidate modification in the system set forth below. gRNAs having a candidate first or second complementarity domain having a selected length, sequence, degree of complementarity, or degree of modification can be evaluated using a system as set forth below. The candidate complementarity domain can be placed, either alone or with one or more other candidate changes in a gRNA molecule/Cas9 molecule system known to be functional with a selected target, and evaluated.

In certain embodiments, the duplexed region formed by the first and second complementarity domains is, for example, 6, 7, 8, 9, 10, 11, 12, 13, 14, 15, 16, 17, 18, 19, 20, 21, or 22 bp in length, excluding any looped out or unpaired nucleotides.

In certain embodiments, the first and second complementarity domains, when duplexed, comprise 11 paired nucleotides (see, for e.g., gRNA of SEQ ID NO:48). In certain embodiments, the first and second complementarity domains, when duplexed, comprise 15 paired nucleotides (see, e.g., gRNA of SEQ ID NO:50). In certain embodiments, the first and second complementarity domains, when duplexed, comprise 16 paired nucleotides (see, e.g., gRNA of SEQ ID NO:51). In certain embodiments, the first and second complementarity domains, when duplexed, comprise 21 paired nucleotides (see, e.g., gRNA of SEQ ID NO:29).

In certain embodiments, one or more nucleotides are exchanged between the first and second complementarity domains to remove poly-U tracts. For example, nucleotides 23 and 48 or nucleotides 26 and 45 of the gRNA of SEQ ID NO:48 may be exchanged to generate the gRNA of SEQ ID NOs:49 or 31, respectively. Similarly, nucleotides 23 and 39 of the gRNA of SEQ ID NO:29 may be exchanged with nucleotides 50 and 68 to generate the gRNA of SEQ ID NO:30.

Linking Domain

The linking domain is disposed between and serves to link the first and second complementarity domains in a unimolecular or chimeric gRNA. FIGS. 1B-1E provide examples of linking domains. In certain embodiments, part of the linking domain is from a crRNA-derived region, and another part is from a tracrRNA-derived region.

In certain embodiments, the linking domain links the first and second complementarity domains covalently. In certain of these embodiments, the linking domain consists of or comprises a covalent bond. In other embodiments, the linking domain links the first and second complementarity domains non-covalently. In certain embodiments, the linking domain is ten or fewer nucleotides in length, e.g., 1, 2, 3, 4, 5, 6, 7, 8, 9, or 10 nucleotides. In other embodiments, the linking domain is greater than 10 nucleotides in length, e.g., 11, 12, 13, 14, 15, 16, 17, 18, 19, 20, 21, 22, 23, 24, or 25 or more nucleotides. In certain embodiments, the linking domain is 2 to 50, 2 to 40, 2 to 30, 2 to 20, 2 to 10, 2 to 5, 10 to 100, 10 to 90, 10 to 80, 10 to 70, 10 to 60, 10 to 50, 10 to 40, 10 to 30, 10 to 20, 10 to 15, 20 to 100, 20 to 90, 20 to 80, 20 to 70, 20 to 60, 20 to 50, 20 to 40, 20 to 30, or 20 to 25 nucleotides in length. In certain embodiments, the linking domain is 10+/−5, 20+/−5, 20+/−10, 30+/−5, 30+/−10, 40+/−5, 40+/−10, 50+/−5, 50+/−10, 60+/−5, 60+/−10, 70+/−5, 70+/−10, 80+/−5, 80+/−10, 90+/−5, 90+/−10, 100+/−5, or 100+/−10 nucleotides in length.

In certain embodiments, the linking domain shares homology with, or is derived from, a naturally occurring sequence, e.g., the sequence of a tracrRNA that is 5' to the second complementarity domain. In certain embodiments, the linking domain has at least 50%, 60%, 70%, 80%, 90%, or 95% homology with or differs by no more than 1, 2, 3, 4, 5, or 6 nucleotides from a linking domain disclosed herein, e.g., the linking domains of FIGS. 1B-1E.

In certain embodiments, the linking domain does not comprise any modifications. In other embodiments, the linking domain or one or more nucleotides therein have a modification, including but not limited to the modifications set forth below. In certain embodiments, one or more nucleotides of the linking domain may comprise a 2' modification (e.g., a modification at the 2' position on ribose), e.g., a 2-acetylation, e.g., a 2' methylation. In certain embodiments, the backbone of the linking domain can be modified with a phosphorothioate. In certain embodiments, modifications to one or more nucleotides of the linking domain render the linking domain and/or the gRNA comprising the linking domain less susceptible to degradation or more bio-compatible, e.g., less immunogenic. In certain embodiments, the linking domain includes 1, 2, 3, 4, 5, 6, 7, or 8 or more modifications, and in certain of these embodiments the linking domain includes 1, 2, 3, or 4 modifications within five nucleotides of its 5' and/or 3' end. In certain embodiments, the linking domain comprises modifications at two or more consecutive nucleotides.

In certain embodiments, modifications to one or more nucleotides in the linking domain are selected to not interfere with targeting efficacy, which can be evaluated by testing a candidate modification using a system as set forth below. gRNAs having a candidate linking domain having a selected length, sequence, degree of complementarity, or degree of modification can be evaluated in a system as set forth below. The candidate linking domain can be placed, either alone or with one or more other candidate changes in a gRNA molecule/RNA-guided nuclease (e.g., Cas9 molecule) system known to be functional with a selected target, and evaluated.

In certain embodiments, the linking domain comprises a duplexed region, typically adjacent to or within 1, 2, or 3 nucleotides of the 3' end of the first complementarity domain and/or the 5' end of the second complementarity domain. In certain of these embodiments, the duplexed region of the linking region is 10+/−5, 15+/−5, 20+/−5, 20+/−10, or 30+/−5 bp in length. In certain embodiments, the duplexed region of the linking domain is 1, 2, 3, 4, 5, 6, 7, 8, 9, 10, 11, 12, 13, 14, or 15 bp in length. In certain embodiments, the sequences forming the duplexed region of the linking domain are fully complementarity. In other embodiments, one or both of the sequences forming the duplexed region contain one or more nucleotides (e.g., 1, 2, 3, 4, 5, 6, 7, or 8 nucleotides) that are not complementary with the other duplex sequence.

5' Extension Domain

Figure 1A:
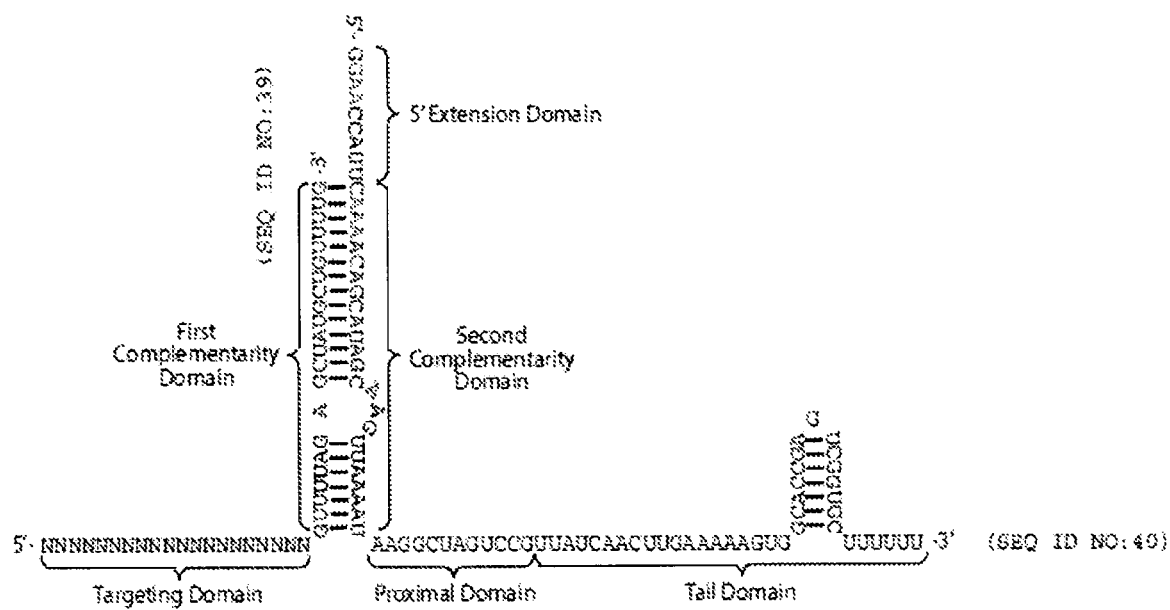
Figure 1B:
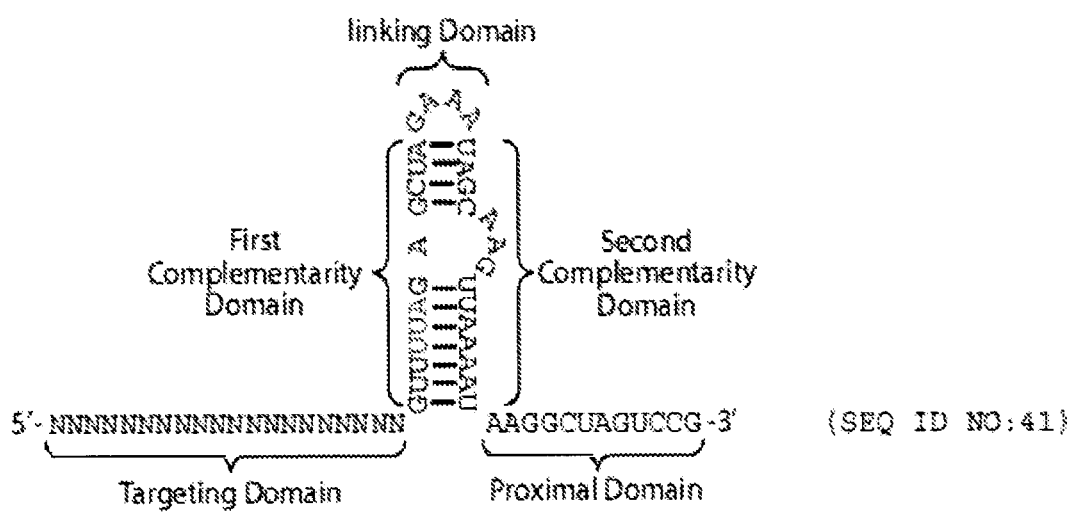
Figure 1C:
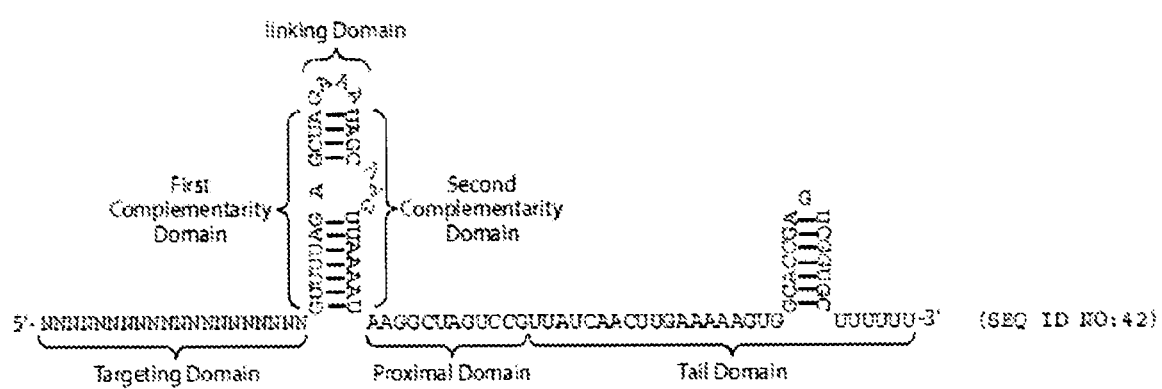
Figure 1D:
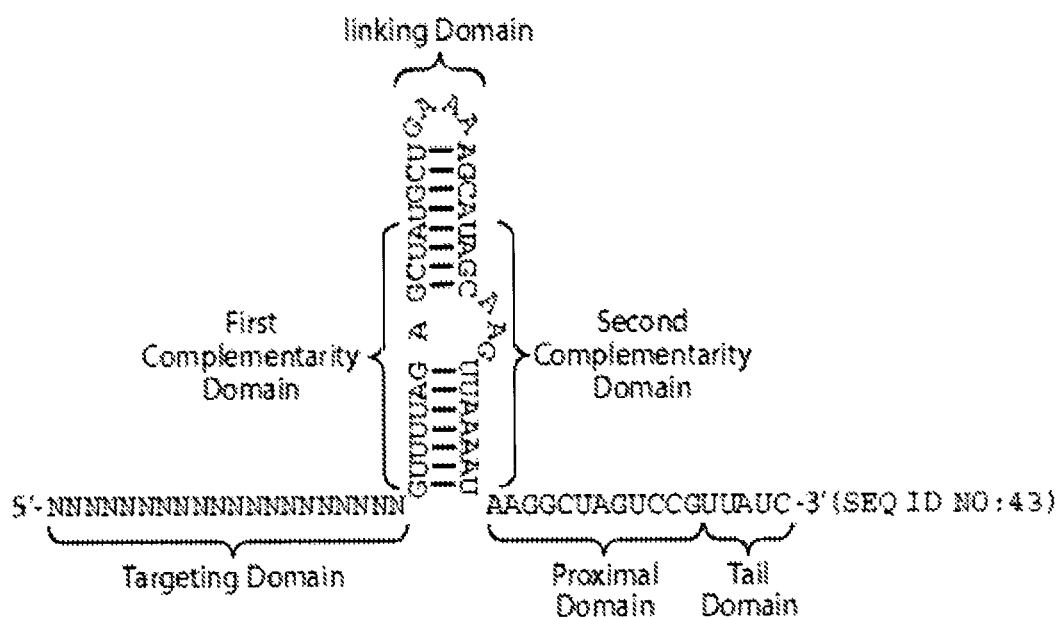
Figure 1E:
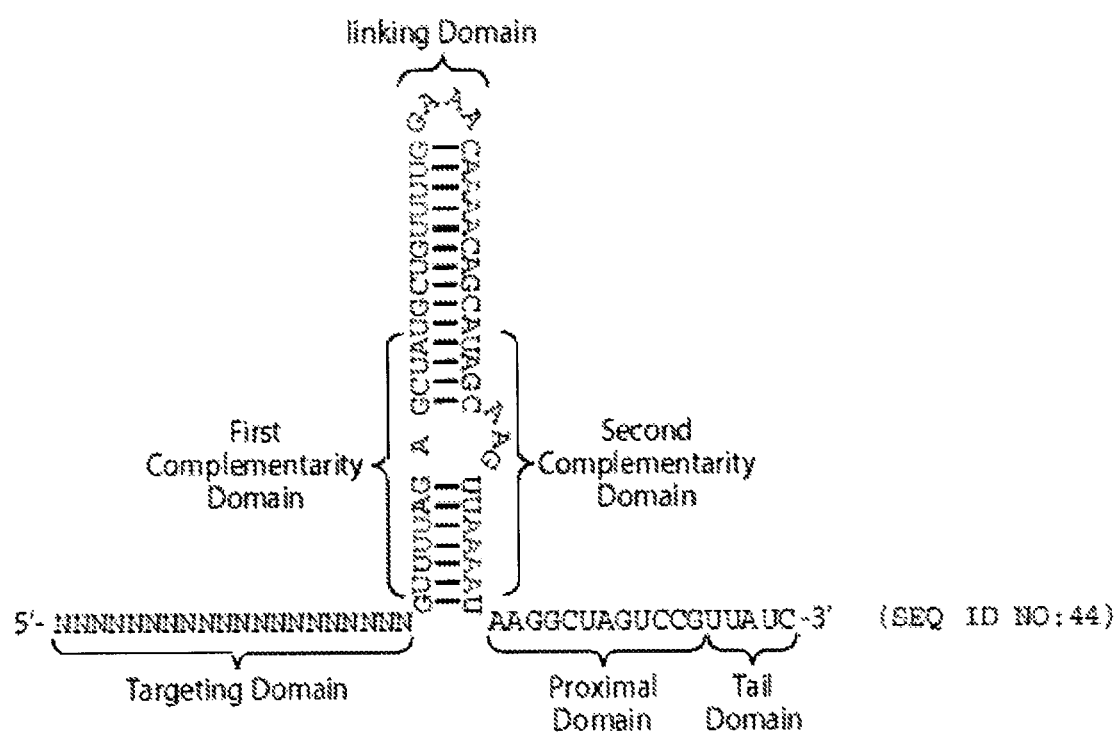
Figure 1F:
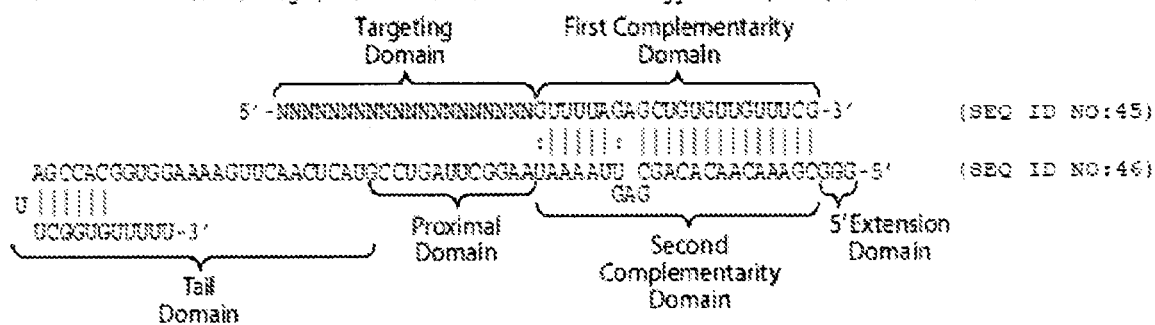

In certain embodiments, a modular gRNA as disclosed herein comprises a 5' extension domain, i.e., one or more additional nucleotides 5' to the second complementarity domain (see, e.g., FIG. 1A). In certain embodiments, the 5' extension domain is 2 to 10 or more, 2 to 9, 2 to 8, 2 to 7, 2 to 6, 2 to 5, or 2 to 4 nucleotides in length, and in certain of these embodiments the 5' extension domain is 2, 3, 4, 5, 6, 7, 8, 9, or 10 or more nucleotides in length.

In certain embodiments, the 5' extension domain nucleotides do not comprise modifications, e.g., modifications of the type provided below. However, in certain embodiments, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) as set forth below. In certain embodiments, a nucleotide of the 5' extension domain can comprise a 2' modification (e.g., a modification at the 2' position on ribose), e.g., a 2-acetylation, e.g., a 2' methylation, or other modification(s) as set forth below.

In certain embodiments, the 5' extension domain can comprise as many as 1, 2, 3, 4, 5, 6, 7, or 8 modifications. In certain embodiments, the 5' extension domain comprises as many as 1, 2, 3, or 4 modifications within 5 nucleotides of its 5' end, e.g., in a modular gRNA molecule. In certain embodiments, the 5' extension domain comprises as many as 1, 2, 3, or 4 modifications within 5 nucleotides of its 3' end, e.g., in a modular gRNA molecule.

In certain embodiments, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In certain embodiments, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In certain embodiments, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in a system as set forth below. gRNAs having a candidate 5' extension domain having a selected length, sequence, degree of complementarity, or degree of modification, can be evaluated in a system as set forth below. The candidate 5' extension domain can be placed, either alone, or with one or more other candidate changes in a gRNA molecule/RNA-guided nuclease (e.g., Cas9 molecule) system known to be functional with a selected target and evaluated.

In certain embodiments, the 5' extension domain has at least 60, 70, 80, 85, 90 or 95% homology with, or differs by no more than 1, 2, 3, 4, 5, or 6 nucleotides from, a reference 5' extension domain, e.g., a naturally occurring, e.g., an S. pyogenes, S. aureus, or S. thermophilus, 5' extension domain, or a 5' extension domain described herein, e.g., from FIGS. 1A-1G.

Proximal Domain

FIGS. 1A-1G provide examples of proximal domains.

In certain embodiments, the proximal domain is 5 to 20 or more nucleotides in length, e.g., 5, 6, 7, 8, 9, 10, 11, 12, 13, 14, 15, 16, 17, 18, 19, 20, 21, 22, 23, 24, 25, or 26 nucleotides in length. In certain of these embodiments, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length. In certain embodiments, the proximal domain is 5 to 20, 7, to 18, 9 to 16, or 10 to 14 nucleotides in length.

In certain embodiments, the proximal domain can share homology with or be derived from a naturally occurring proximal domain. In certain of these embodiments, the proximal domain has at least 50%, 60%, 70%, 80%, 85%, 90%, or 95% homology with or differs by no more than 1, 2, 3, 4, 5, or 6 nucleotides from a proximal domain disclosed herein, e.g., an S. pyogenes, S. aureus, or S. thermophilus proximal domain, including those set forth in FIGS. 1A-1G.

In certain embodiments, the proximal domain does not comprise any modifications. In other embodiments, the proximal domain or one or more nucleotides therein have a modification, including but not limited to the modifications set forth in herein. In certain embodiments, one or more nucleotides of the proximal domain may comprise a 2' modification (e.g., a modification at the 2' position on ribose), e.g., a 2-acetylation, e.g., a 2' methylation. In certain embodiments, the backbone of the proximal domain can be modified with a phosphorothioate. In certain embodiments, modifications to one or more nucleotides of the proximal domain render the proximal domain and/or the gRNA comprising the proximal domain less susceptible to degradation or more bio-compatible, e.g., less immunogenic. In certain embodiments, the proximal domain includes 1, 2, 3, 4, 5, 6, 7, or 8 or more modifications, and in certain of these embodiments the proximal domain includes 1, 2, 3, or 4 modifications within five nucleotides of its 5' and/or 3' end. In certain embodiments, the proximal domain comprises modifications at two or more consecutive nucleotides.

In certain embodiments, modifications to one or more nucleotides in the proximal domain are selected to not interfere with targeting efficacy, which can be evaluated by testing a candidate modification in a system as set forth below. gRNAs having a candidate proximal domain having a selected length, sequence, degree of complementarity, or degree of modification can be evaluated in a system as set forth below. The candidate proximal domain can be placed, either alone or with one or more other candidate changes in a gRNA molecule/RNA-guided nuclease (e.g., Cas9 molecule) system known to be functional with a selected target, and evaluated.

Tail Domain

A broad spectrum of tail domains are suitable for use in the gRNA molecules disclosed herein. FIGS. 1A and 1C-1G provide examples of such tail domains.

In certain embodiments, the tail domain is absent. In other embodiments, the tail domain is 1 to 100 or more nucleotides in length, e.g., 1, 2, 3, 4, 5, 6, 7, 8, 9, 10, 20, 30, 40, 50, 60, 70, 80, 90, or 100 nucleotides in length. In certain embodiments, the tail domain is 1 to 5, 1 to 10, 1 to 15, 1 to 20, 1 to 50, 10 to 100, 20 to 100, 10 to 90, 20 to 90, 10 to 80, 20 to 80, 10 to 70, 20 to 70, 10 to 60, 20 to 60, 10 to 50, 20 to 50, 10 to 40, 20 to 40, 10 to 30, 20 to 30, 20 to 25, 10 to 20, or 10 to 15 nucleotides in length. In certain embodiments, the tail domain is 5+/−5, 10+/−5, 20+/−10, 20+/−5, 25+/−10, 30+/−10, 30+/−5, 40+/−10, 40+/−5, 50+/−10, 50+/−5, 60+/−10, 60+/−5, 70+/−10, 70+/−5, 80+/−10, 80+/−5, 90+/−10, 90+/−5, 100+/−10, or 100+/−5 nucleotides in length.

In certain embodiments, the tail domain can share homology with or be derived from a naturally occurring tail domain or the 5' end of a naturally occurring tail domain. In certain of these embodiments, the proximal domain has at least 50%, 60%, 70%, 80%, 85%, 90%, or 95% homology with or differs by no more than 1, 2, 3, 4, 5, or 6 nucleotides from a naturally occurring tail domain disclosed herein, e.g., an *S. pyogenes, S. aureus*, or *S. thermophilus* tail domain, including those set forth in FIGS. 1A and 1C-1G.

In certain embodiments, the tail domain includes sequences that are complementary to each other and which, under at least some physiological conditions, form a duplexed region. In certain of these embodiments, the tail domain comprises a tail duplex domain which can form a tail duplexed region. In certain embodiments, the tail duplexed region is 3, 4, 5, 6, 7, 8, 9, 10, 1, or 12 bp in length. In certain embodiments, the tail domain comprises a single stranded domain 3' to the tail duplex domain that does not form a duplex. In certain of these embodiments, the single stranded domain is 3 to 10 nucleotides in length, e.g., 3, 4, 5, 6, 7, 8, 9, 10, or 4 to 6 nucleotides in length.

In certain embodiments, the tail domain does not comprise any modifications. In other embodiments, the tail domain or one or more nucleotides therein have a modification, including but not limited to the modifications set forth herein. In certain embodiments, one or more nucleotides of the tail domain may comprise a 2' modification (e.g., a modification at the 2' position on ribose), e.g., a 2-acetylation, e.g., a 2' methylation. In certain embodiments, the backbone of the tail domain can be modified with a phosphorothioate. In certain embodiments, modifications to one or more nucleotides of the tail domain render the tail domain and/dr the gRNA comprising the tail domain less susceptible to degradation or more bio-compatible, e.g., less immunogenic. In certain embodiments, the tail domain includes 1, 2, 3, 4, 5, 6, 7, or 8 or more modifications, and in certain of these embodiments the tail domain includes 1, 2, 3, or 4 modifications within five nucleotides of its 5' and/or 3' end. In certain embodiments, the tail domain comprises modifications at two or more consecutive nucleotides.

In certain embodiments, modifications to one or more nucleotides in the tail domain are selected to not interfere with targeting efficacy, which can be evaluated by testing a candidate modification as set forth below. gRNAs having a candidate tail domain having a selected length, sequence, degree of complementarity, or degree of modification can be evaluated using a system as set forth below. The candidate tail domain can be placed; either alone or with one or more other candidate changes in a gRNA molecule/RNA-guided nuclease (e.g., Cas9 molecule) system known to be functional with a selected target, and evaluated.

In certain embodiments, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When an H1 promoter is used for transcription, these nucleotides may be the sequence UUUU. When alternate pol-III promoters are used, these nucleotides may be various numbers of uracil bases depending on, e.g., the termination signal of the pol-III promoter, or they may include alternate bases.

In certain embodiments, the proximal and tail domain taken together comprise, consist of or consist essentially of the sequence set forth in SEQ ID NOs:32, 33, 34, 35, 36, or 37.

Exemplary Unimolecular/Chimeric gRNAs

In certain embodiments, a unimolecular or chimeric gRNA as disclosed herein has the structure: 5' [targeting domain]-[first complementarity domain]-[linking domain]-[second complementarity domain]-[proximal domain]-[tail domain]-3', wherein:

the targeting domain comprises a core domain and optionally a secondary domain, and is 10 to 50 nucleotides in length;

the first complementarity domain is 5 to 25 nucleotides in length and, in certain embodiments has at least 50, 60, 70, 80, 85, 90, or 95% homology with a reference first complementarity domain disclosed herein;

the linking domain is 1 to 5 nucleotides in length;

the second complementarity domain is 5 to 27 nucleotides in length and, in certain embodiments has at least 50, 60, 70, 80, 85, 90, or 95% homology with a reference second complementarity domain disclosed herein;

the proximal domain is 5 to 20 nucleotides in length and, in certain embodiments has at least 50, 60, 70, 80, 85, 90, or 95% homology with a reference proximal domain disclosed herein; and the tail domain is absent or a nucleotide sequence is 1 to 50 nucleotides in length and, in certain embodiments has at least 50, 60, 70, 80, 85, 90, or 95% homology with a reference tail domain disclosed herein.

In certain embodiments, a unimolecular gRNA as disclosed herein comprises, preferably from 5' to 3':
  a targeting domain, e.g., comprising 10-50 nucleotides;
  a first complementarity domain, e.g., comprising 15, 16, 17, 18, 19, 20, 21, 22, 23, 24, 25, or 26 nucleotides;
  a linking domain;
  a second complementarity domain;
  a proximal domain; and
  a tail domain,
  wherein,
  (a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the sequence from (a), (b), and/or (c) has at least 50%, 60%, 70%, 75%, 80%, 85%, 90%, 95%, or 99% homology with the corresponding sequence of a naturally occurring gRNA, or with a gRNA described herein.

In certain embodiments, the proximal and tail domain, when taken together, comprise at least 15, 18, 20, 25, 30, 31, 35, 40, 45, 49, 50, or 53 nucleotides.

In certain embodiments, there are at least 15, 18, 20, 25, 30, 31, 35, 40, 45, 49, 50, or 53 nucleotides 3' to the last nucleotide of the second complementarity domain.

In certain embodiments, there are at least 16, 19, 21, 26, 31, 32, 36, 41, 46, 50, 51, or 54 nucleotides 3' to the last nucleotide of the second complementarity domain that are complementary to the corresponding nucleotides of the first complementarity domain.

In certain embodiments, the targeting domain consists of, consists essentially of, or comprises 16, 17, 18, 19, 20, 21, 22, 23, 24, 25, or 26 nucleotides (e.g., 16, 17, 18, 19, 20, 21, 22, 23, 24, 25, or 26 consecutive nucleotides) complementary or partially complementary to the target domain or a portion thereof, e.g., the targeting domain is 16, 17, 18, 19, 20, 21, 22, 23, 24, 25, or 26 nucleotides in length. In certain of these embodiments, the targeting domain is complementary to the target domain over the entire length of the targeting domain, the entire length of the target domain, or both.

In certain embodiments, a unimolecular or chimeric gRNA molecule disclosed herein (comprising a targeting domain, a first complementarity domain, a linking domain, a second complementarity domain, a proximal domain and, optionally, a tail domain) comprises the nucleotide sequence set forth in SEQ ID NO:42, wherein the targeting domain is listed as 20 Ns (residues 1-20) but may range in length from 16 to 26 nucleotides and wherein the final six residues (residues 97-102) represent a termination signal for the U6 promoter but may be absent or fewer in number. In certain embodiments, the unimolecular, or chimeric, gRNA molecule is a S. pyogenes gRNA molecule.

In certain embodiments, a unimolecular or chimeric gRNA molecule disclosed herein (comprising a targeting domain, a first complementarity domain, a linking domain, a second complementarity domain, a proximal domain and, optionally, a tail domain) comprises the nucleotide sequence set forth in SEQ ID NO:38, wherein the targeting domain is listed as 20 Ns (residues 1-20) but may range in length from 16 to 26 nucleotides, and wherein the final six residues (residues 97-102) represent a termination signal for the U6 promoter but may be absent or fewer in number. In certain embodiments, the unimolecular or chimeric gRNA molecule is an S. aureus gRNA molecule.

The sequences and structures of exemplary chimeric gRNAs are also shown in FIGS. 1II-1I.

Exemplary Modular gRNAs

In certain embodiments, a modular gRNA disclosed herein comprises:
a first strand comprising, preferably from 5' to 3';
a targeting domain, e.g., comprising 15, 16, 17, 18, 19, 20, 21, 22, 23, 24, 25, or 26 nucleotides;
a first complementarity domain; and a second strand, comprising, preferably from 5' to 3':
optionally a 5' extension domain;
a second complementarity domain;
a proximal domain; and
a tail domain,
wherein:
(a) the proximal and tail domain, when taken together, comprise at least 15, 18, 20, 25, 30, 31, 35, 40, 45, 49, 50, or 53 nucleotides;
(b) there are at least 15, 18, 20, 25, 30, 31, 35, 40, 45, 49, 50, or 53 nucleotides 3' to the last nucleotide of the second complementarity domain; or
(c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the sequence from (a), (b), or (c), has at least 60, 75, 80, 85, 90, 95, or 99% homology with the corresponding sequence of a naturally occurring gRNA, or with a gRNA described herein.

In certain embodiments, the proximal and tail domain, when taken together, comprise at least 15, 18, 20, 25, 30, 31, 35, 40, 45, 49, 50, or 53 nucleotides.

In certain embodiments, there are at least 15, 18, 20, 25, 30, 31, 35, 40, 45, 49, 50, or 53 nucleotides 3' to the last nucleotide of the second complementarity domain:

In certain embodiments, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 16, 17, 18, 19, 20, 21, 22, 23, 24, 25, or 26 nucleotides (e.g., 16, 17, 18, 19, 20, 21, 22, 23, 24, 25, or 26 consecutive nucleotides) having complementarity with the target domain, e.g., the targeting domain is 16, 17, 18, 19, 20, 21, 22, 23, 24, 25, or 26 nucleotides in length.

In certain embodiments, the targeting domain consists of, consists essentially of, or comprises 16, 17, 18, 19, 20, 21, 22, 23, 24, 25, or 26 nucleotides (e.g., 16, 17, 18, 19, 20, 21, 22, 23, 24, 25, or 26 consecutive nucleotides) complementary to the target domain or a portion thereof. In certain of these embodiments, the targeting domain is complementary to the target domain over the entire length of the targeting domain, the entire length of the target domain, or both.

In certain embodiments, the targeting domain comprises, consists of, or consists essentially of 16 nucleotides (e.g., 16 consecutive nucleotides) having complementarity with the target domain, e.g., the targeting domain is 16 nucleotides in length. In certain embodiments of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 17 nucleotides (e.g., 17 consecutive nucleotides) having complementarity with the target domain, e.g., the targeting domain is 17 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 18 nucleotides (e.g., 18 consecutive nucleotides) having complementarity with the target domain, e.g., the targeting domain is 18 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 19 nucleotides (e.g., 19 consecutive nucleotides) having complementarity with the target domain, e.g., the targeting domain is 19 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 20 nucleotides (e.g., 20 consecutive nucleotides) having complementarity with the target domain, e.g., the targeting domain is 20 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 21 nucleotides (e.g., 21 consecutive nucleotides) having complementarity with the target domain, e.g., the targeting domain is 21 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 22 nucleotides (e.g., 22 consecutive nucleotides) having complementarity with the target domain, e.g., the targeting domain is 22 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 23 nucleotides (e.g., 23 consecutive nucleotides) having complementarity with the target domain, e.g., the targeting domain is 23 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 24 nucleotides (e.g., 24 consecutive nucleotides) having complementarity with the target domain, e.g., the targeting domain is 24 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 25 nucleotides (e.g., 25 consecutive nucleotides) having complementarity with the target domain, e.g., the targeting domain is 25 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, consists of, or consists essentially of 26 nucleotides (e.g., 26 consecutive nucleotides) having complementarity with the target domain, e.g., the targeting domain is 26 nucleotides in length. In certain of these embodiments, (a) the proximal and tail domain, when taken together, comprise at least 15, 18, 20, 25, 30, 31, 35, 40, 45, 49, 50, or 53 nucleotides; (b) there are at least 15, 18, 20, 25, 30, 31, 35, 40, 45, 49, 50, or 53 nucleotides 3' to the last nucleotide of the second complementarity domain; and/or there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

gRNA Delivery

In certain embodiments of the methods provided herein, the methods comprise delivery of one or more (e.g., two, three, or tour) gRNA molecules as described herein. In certain of these embodiments, the gRNA molecules are delivered by intrahepatic injection, intraparenchymal injection into liver, intraparenchymal injection into the lung, intravenous delivery into the portal vein, intravenous injection, intramuscular injection, subcutaneous injection, or inhalation.

Methods for Designing RNAs

Methods for selecting, designing, and validating targeting domains for use in the gRNAs described herein are provided. Exemplary targeting domains for incorporation into gRNAs are also provided herein. It is contemplated herein that in certain embodiments the targeting domain hybridizes to the target domain through complementary base pairing.

Methods for selection and validation of target sequences as well as off-target analyses have been described previously (see, e.g., Mali 2013; Hsu 2013; Fu 2014; Heigwer 2014; Bae 2014; Xiao 2014). For example, a software tool can be used to optimize the choice of potential targeting domains corresponding to a user's target sequence, e.g., to minimize total off-target activity across the genome. Off-target activity may be other than cleavage. For each possible targeting domain choice using S. pyogenes Cas9, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible targeting domain is then ranked according to its total predicted off-target cleavage; the top-ranked targeting domains represent those that are likely to have the greatest on-target cleavage and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate targeting domains and gRNAs comprising those targeting domains can be functionally evaluated using methods known in the art and/or as set forth herein.

As a non-limiting example, targeting domains for use in gRNAs for use with S. pyogenes and S. aureus Cas9s were identified using a DNA sequence searching algorithm. 17-mer and 20-mer targeting domains were designed for S. pyogenes targets, while 18-mer, 19-mer, 20-mer, 21-mer, 22-mer, 23-mer, and 24-mer targeting domains were designed for S. aureus targets. gRNA design was carried out using custom gRNA design software based on the public tool cas-offinder (Bae 2014). This software scores guides after calculating their genome-wide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential target sites adjacent to PAM sequences, the software also identifies all PAM adjacent sequences that differ by 1, 2, 3, or more than 3 nucleotides from the selected target sites. Genomic DNA sequences for SERPINA1 were obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, targeting domain were ranked into tiers based on their orthogonality and the presence of a 5' G (based on identification of close matches in the human genome containing a relevant PAM, e.g., an NGG PAM for S. pyogenes, or an NNGRRT (SEQ ID NO:204) or NNGRRV (SEQ ID NO:205) PAM for S. aureus). Orthogonality refers to the number of sequences in the human genome that contain a minimum number of mismatches to the target sequence. A "high level of orthogonality" or "good orthogonality" may, for example, refer to 20-mer targeting domain that have no identical sequences in the human genome besides the intended target, nor any sequences that contain one or two mismatches in the target sequence. Targeting domains with good orthogonality are selected to minimize off-target DNA cleavage.

Targeting domains were identified for both single-gRNA nuclease cleavage and for a dual-gRNA paired "nickase" strategy. Criteria for selecting targeting domains and the determination of which targeting domains can be used for the dual-gRNA paired "nickase" strategy is based on two considerations:

(1) Targeting domain pairs should be oriented on the DNA such that PAMs are facing out and cutting with the D10A Cas9 nickase will result in 5' overhangs; and (2) An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the target site of one targeting domain.

Targeting Domains for Use in Knocking in the Correct Nucleotide at the Z Allele in SERPINA1 Using HDR (Approach 1A)

Targeting domains for use in gRNAs for knocking in the correct nucleotide at the Z mutation in SERPINA1 using HDR in conjunction with the methods disclosed herein (e.g., Approach 1A) were identified and ranked into four tiers for S. pyogenes and five tiers for S. aureus. In each case, targeting domains were designed to bind within the sequence spanning 200 bp upstream and 200 bp downstream of the Z mutation (i.e., from nucleotides 13790 to 14190 in SEQ ID NO:2231).

For S. pyogenes, tier 1 targeting domains were selected based on (1) high level of orthogonality and (2) presence of 5' G. Tier 2 targeting domains were selected based on (1) high level of orthogonality. Tier 3 targeting domains were selected based on (1) presence of 5' G. Tier 4 targeting domains were selected based on their ability to bind within the region spanning 200 bp upstream and 200 bp downstream of the Z mutation (i.e.; from nucleotides 13790 to 14190 in SEQ ID NO:2231).

For S. aureus, tier 1 targeting domains were selected based on (1) high level of orthogonality, (2) presence of 5' G, and (3) PAM sequence NNGRRT (SEQ ID NO:204). Tier 2 targeting domains were selected based on (1) high level of orthogonality and (2) PAM sequence NNGRRT (SEQ ID NO:204). Tier 3 targeting domains were selected based on (1) presence of 5' G and (2) PAM sequence NNGRRT (SEQ ID NO:204). Tier 4 targeting domains were selected based on (1) PAM sequence NNGRRT (SEQ ID NO:204). Tier 5 targeting domains were selected based on (1) PAM sequence NNGRRV (SEQ ID NO:205).

Note that tiers are non-inclusive (each targeting domain is listed only once for the strategy). The identified targeting domains are summarized in Table 6.

TABLE 6

Nucleotide sentiences of *S. pyogenes* and *S. aureus* targeting domains for use in Approach 1A

| | S. pyogenes | S. aureus |
|---|---|---|
| Tier 1 | SEQ ID NOs: 253-262 | SEQ ID NOs: 402-412 |
| Tier 2 | SEQ ID NOs: 263-275 | SEQ ID NOs: 272, 413-438 |
| Tier 3 | SEQ ID NOs: 276-310 | SEQ ID NOs: 306, 439-445 |
| Tier 4 | SEQ ID NOs: 311-401 | SEQ ID NOs: 382, 392, 446-460 |
| Tier 5 | NA | SEQ ID NOs: 255, 257, 258, 260, 261, 265, 268, 271, 274, 295, 298, 300, 301, 302, 308, 309, 371, 374, 375, 377, 384, 385, 388, 389, 393, 395, 397, 461-883, 2191, 2192 |

Targeting Domains for Use in Knocking Out the Z Allele in SERPINA1 by Targeting Exon IV or V Using NHEJ (Approach 1B)

Targeting domains for use in gRNAs for knocking out the Z mutant allele of SERPINA1 in conjunction with the methods disclosed herein targeting either Exon IV or Exon V (e.g., Approach 1B) were identified and ranked into four tiers for *S. pyogenes* and five tiers for *S. aureus*. Targeting domains for use in targeting Exon IV were designed to bind within the sequence spanning the Exon IV coding sequence and up to 30 bp upstream or downstream thereof (i.e., from nucleotides 12959 to 13166 in SEQ ID NO:2231). Targeting domains for use in targeting Exon V were designed to bind within the sequencing spanning the Exon V coding sequence and up to 30 bp upstream thereof (i.e., from nucleotides 13930 to 14151 in SEQ ID NO:2231).

For *S. pyogenes*, tier 1 targeting domains were selected based on (1) high level of orthogonality and (2) presence of 5' G. Tier 2 targeting domains were selected based on (1) high level of orthogonality. Tier 3 targeting domains were selected based on (1) presence of 5' G. Tier 4 targeting domains for use in targeting Exon IV were selected based on their ability to bind within the Exon IV coding sequence and/or up to 30 bp upstream or downstream of the Exon IV coding sequence (i.e., from nucleotides 12959 to 13166 in SEQ ID NO:2231). Tier 4 targeting domains for use in targeting Exon V were selected based on their ability to bind within the Exon V coding sequence and/or up to 30 bp upstream of the Exon V coding sequence (i.e., from nucleotides 13930 to 14151 in SEQ ID NO:2231).

For *S. aureus*, tier 1 targeting domains were selected based on (1) high level of orthogonality, (2) presence of 5' G, and (3) PAM sequence NNGRRT (SEQ ID NO:204). Tier 2 targeting domains were selected based on (1) high level of orthogonality and (2) PAM sequence NNGRRT (SEQ ID NO:204). Tier 3 targeting domains were selected based on (1) presence of 5' G and (2) PAM sequence NNGRRT (SEQ ID NO:204). Tier 4 targeting domains were selected based on (1) PAM sequence NNGRRT (SEQ ID NO:204). Tier 5 targeting domains were selected based on (1) PAM sequence NNGRRV (SEQ ID NO:205).

Note that tiers are non-inclusive (each targeting domain is listed only once for the strategy). The identified targeting domains for targeting Exons IV and V are summarized in Tables 7 and 8, respectively.

TABLE 7

Nucleotide sequences of *S. pyogenes* and *S. aureus* targeting domains for use in Approach 1B targeting Exon IV

| | S. pyogenes | S. aureus |
|---|---|---|
| Tier 1 | SEQ ID NOs: 884 | SEQ ID NOs: 944-949 |
| Tier 2 | SEQ ID NOs: 885-892 | SEQ ID NOs: 935, 950-964 |
| Tier 3 | SEQ ID NOs: 893-904 | SEQ ID NOs: 965, 966 |
| Tier 4 | SEQ ID NOs: 905-943 | SEQ ID NOs: 936, 967-969 |
| Tier 5 | NA | SEQ ID NOs: 886, 901, 931, 937, 943, 970-1139 |

TABLE 8

Nucleotide sequences of *S. pyogenes* and *S. aureus* targeting domains for use in Approach 1B targeting Exon V

| | S. pyogenes | S. aureus |
|---|---|---|
| Tier 1 | SEQ ID NOs: 253, 254, 256-258, 260 | SEQ ID NOs: 402-406 |
| Tier 2 | SEQ ID NOs: 265, 266, 270-275 | SEQ ID NOs: 272, 413-420, 435-438 |
| Tier 3 | SEQ ID NOs: 282, 290, 295, 297, 301, 307, 309 | SEQ ID NO: 439 |
| Tier 4 | SEQ ID NOs: 311-316, 320-323, 325, 326, 332, 334, 336-340, 344, 345, 347, 348, 352, 353, 356, 357, 361-364, 366, 368-370, 374-376, 383, 385, 387-389, 391, 395, 396, 398 | SEQ ID NOs: 446-451, 458-460 |
| Tier 5 | NA | SEQ ID NOs: 257, 258, 260, 265, 271, 274, 295, 301, 309, 374, 375, 385, 388, 389, 395, 461-473, 481-493, 501-507, 521-527, 535-540, 555-611, 615-620, 628-641, 648-667, 671-676, 689-708, 722-728, 743-749, 756-762, 789-794, 816-822, 851-857, 865-870, 877-883 |

Targeting Domains for Use in Knocking Out the S Allele, Z Allele, or Other Mutant Alleles in SERPINA1 by Targeting an Early Coding Region Using NHEJ (Approaches 2A and 2B)

Targeting domains for use in gRNAs for knocking out the S allele, Z allele, or another mutant allele of SERPINA1 in conjunction with the methods disclosed herein targeting an early coding region of SERPINA1 (e.g., Approaches 2A, 2B) were identified and ranked into four tiers for *S. pyogenes* and five tiers for *S. aureus*. In each case, targeting domains were designed to bind within the sequence spanning the first coding exon of SERPINA1 (i.e., Exon II) and 30 bp upstream or downstream thereof (i.e., from nucleotides 9329 to 9643 in SEQ ID NO:2231).

For *S. pyogenes*, tier 1 targeting domains were selected based on (1) high level of orthogonality and (2) presence of 5' G. Tier 2 targeting domains were selected based on (1) high level of orthogonality. Tier 3 targeting domains were selected based on (1) presence of 5' G. Tier 4 targeting domains were selected based on their ability to bind within the sequence spanning the first coding exon of SERPINA1 (i.e., Exon II) and 30 bp upstream or downstream thereof (i.e., from nucleotides 9329 to 9643 in SEQ ID NO:2231).

For *S. aureus*, tier 1 targeting domains were selected based on (1) high level of orthogonality, (2) presence of 5'

G, and (3) PAM sequence NNGRRT (SEQ ID NO:204). Tier 2 targeting domains were selected based on (1) high level of orthogonality and (2) PAM sequence NNGRRT (SEQ ID NO:204). Tier 3 targeting domains were selected based on (1) presence of 5' G and (2) PAM sequence NNGRRT (SEQ ID NO:204). Tier 4 targeting domains were selected based on (1) PAM sequence NNGRRT (SEQ ID NO:204). Tier 5 targeting domains were selected based on (1) PAM sequence NNGRRV (SEQ ID NO:205).

Note that tiers are non-inclusive (each targeting domain is listed only once for the strategy). The identified targeting domains are summarized in Table 9.

TABLE 9

Nucleotide sequences of S. pyogenes and S. aureus targeting domains for use in Approaches 2A and 2B

| | S. pyogenes | S. aureus |
|---|---|---|
| Tier 1 | SEQ ID NOs: 1140-1147 | SEQ ID NOs: 1374-1404 |
| Tier 2 | SEQ ID NOs: 1148-1165 | SEQ ID NOs: 1165, 1349, 1359, 1362, 1405-1480 |
| Tier 3 | SEQ ID NOs: 1166-1233 | SEQ ID NOs: 1481-1499 |
| Tier 4 | SEQ ID NOs: 1234-1373 | SEQ ID NOs: 1371, 1500-1522 |
| Tier 5 | NA | SEQ ID NOs: 1141, 1143, 1147, 1153, 1156, 1158, 1160, 1317, 1320-1323, 1325, 1329, 1333, 1336-1338, 1340, 1342, 1343, 1352, 1365, 1368, 1370, 1523-2190 |

In certain embodiments, two or more (e.g., three or four) gRNA molecules are used with one RNA-guided nuclease (e.g., Cas9 molecule). In another embodiment, when two or more (e.g., three or four) gRNAs are used with two or more RNA-guided nucleases (e.g., Cas9 molecules), at least one RNA-guided nuclease (e.g., Cas9 molecule) is from a different species than the other RNA-guided nuclease(s) (e.g., Cas9 molecule(s)). For example, when two gRNA molecules are used with two RNA-guided nucleases (e.g., Cas9 molecules), one RNA-guided nuclease (e.g., Cas9 molecule) can be from one species and the other RNA-guided nuclease (e.g., Cas9 molecule) can be from a different species. Both RNA-guided nuclease (e.g., Cas9 molecule) species are used to generate a single or double-strand break, as desired.

Any of the targeting domains in Tables 6-9 can be used in conjunction with an S. pyogenes or S. aureus Cas9 nickase molecule to generate a single-strand break, or with an RNA-guided nuclease (e.g., a Cas9 molecule) to generate a double-strand break.

When two gRNAs are designed for use with two RNA-guided nucleases (e.g., Cas9 molecules), the two RNA-guided nucleases (e.g., Cas9 molecules) may be different species. Both RNA-guided nuclease (e.g., Cas9 molecule) species may be used to generate a single or double-strand break, as desired.

It is contemplated herein that any upstream gRNA described herein may be paired with any downstream gRNA described herein. When an upstream gRNA designed for use with one species of RNA-guided nuclease (e.g., Cas9) is paired with a downstream gRNA designed for use from a different species of RNA-guided nuclease (e.g., Cas9 molecule), both RNA-guided nuclease (e.g., Cas9 molecule) species are used to generate a single or double-strand break, as desired.

RNA-Guided Nucleases

RNA-guided nucleases according to the present disclosure include, but are not limited to, naturally-occurring Class 2 CRISPR nucleases such as Cas9, and Cpf1, as well as other nucleases derived or obtained therefrom. In functional terms, RNA-guided nucleases are defined as those nucleases that: (a) interact with (e.g., complex with) a gRNA; and (b) together with the gRNA, associate with, and optionally cleave or modify, a target region of a DNA that includes (i) a sequence complementary to the targeting domain of the gRNA and, optionally, (ii) a PAM. RNA-guided nucleases can be defined, in broad terms, by their PAM specificity and cleavage activity, even though variations may exist between individual RNA-guided nucleases that share the same PAM specificity or cleavage activity. Skilled artisans will appreciate that some aspects of the present disclosure relate to systems, methods and compositions that can be implemented using any suitable RNA-guided nuclease having a certain PAM specificity and/or cleavage activity. For this reason, unless otherwise specified, the term RNA-guided nuclease should be understood as a generic term, and not limited to any particular type (e.g., Cas9 vs. Cpf1), species (e.g., S. pyogenes vs. S. aureus) or variation (e.g., full-length vs. truncated or split; naturally-occurring PAM specificity vs. engineered PAM specificity, etc.) of RNA-guided nuclease.

The PAM sequence takes its name from its sequential relationship to the "protospacer" sequence that is complementary to gRNA targeting domains (or "spacers"). Together with protospacer sequences, PAM sequences define target regions or sequences for specific RNA-guided nuclease/gRNA combinations.

Various RNA-guided nucleases may require different sequential relationships between PAMs and protospacers. In general, Cas9s recognize PAM sequences that are 3' of the protospacer as visualized relative to the top or complementary strand:

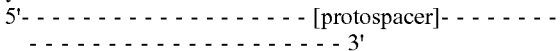

Cpf1, on the other hand, generally recognizes PAM sequences that are 5' of the protospacer:

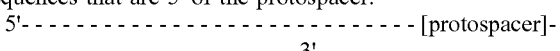
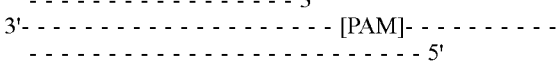

In addition to recognizing specific sequential orientations of PAMs and protospacers, RNA-guided nucleases can also recognize specific PAM sequences. S. aureus Cas9, for instance, recognizes a PAM sequence of NNGRRT or NNGRRV, wherein the N residues are immediately 3' of the region recognized by the gRNA targeting domain. S. pyogenes Cas9 recognizes NGG PAM sequences. And F. novicida Cpf1 recognizes a TTN PAM sequence. PAM sequences have been identified for a variety of RNA-guided nucleases, and a strategy for identifying novel PAM sequences has been described by Shmakov 2015. It should also be noted that engineered RNA-guided nucleases can have PAM specificities that differ from the PAM specificities of reference molecules (for instance, in the case of an engineered RNA-guided nuclease, the reference molecule may be the naturally occurring variant from which the RNA-guided nuclease is derived, or the naturally occurring variant having the greatest amino acid sequence homology to the engineered RNA-guided nuclease).

In addition to their PAM specificity, RNA-guided nucleases can be characterized by their DNA cleavage activity:

naturally-occurring RNA-guided nucleases typically form DSBs in target nucleic acids, but engineered variants have been produced that generate only SSBs (discussed above) Ran 2013, incorporated by reference herein), or that that do not cut at all.

Cas9 Molecules

Cas9 molecules of a variety of species can be used in the methods and compositions described herein. While *S. pyogenes, S. aureus*, and *S. thermophilus* Cas9 molecules are the subject of much of the disclosure herein, Cas9 molecules of, derived from, or based on the Cas9 proteins of other species listed herein can be used as well. These include, for example, Cas9 molecules from *Acidovorax avenae, Actinobacillus pleuropneumoniae, Actinobacillus succinogenes, Actinobacillus suis, Actinomyces* sp., *cycliphilus denitrificans, Aminomonas paucivorans, Bacillus cereus, Bacillus smithii, Bacillus thuringiensis, Bacteroides* sp., *Blastopirellula marina, Bradyrhizobium* sp., *Brevibacillus laterosporus, Campylobacter coli, Campylobacter jejuni, Campylobacter lari, Candidatus Puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tistrella mobilis, Treponema* sp., or *Verminephrobacter eiseniae*.

Cas9 Domains

Crystal structures have been determined for two different naturally occurring bacterial Cas9 molecules (Jinek 2014) and for *S. pyogenes* Cas9 with a guide RNA (e.g., a synthetic fusion of crRNA and tracrRNA) (Nishimasu 2014; Anders 2014).

Figure 8A:
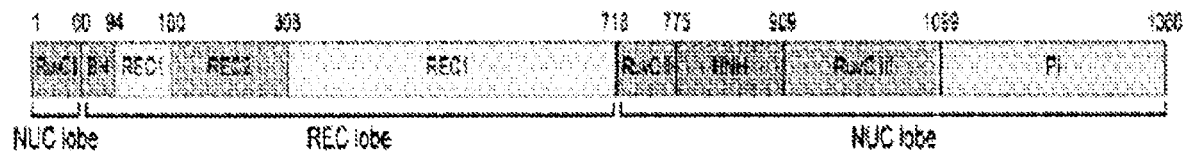
FIGS. 8A and 8B provide schematic representations of the domain organization of *S. pyogenes* Cas9.
Figure 8B:
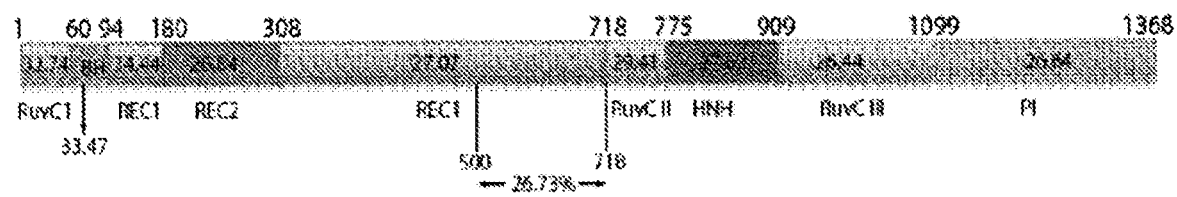

A naturally occurring Cas9 molecule comprises two lobes: a recognition (REC) lobe and a nuclease (NUC) lobe; each of which further comprise domains described herein. FIGS. 8A-8B provide a schematic of the organization of important Cas9 domains in the primary structure. The domain nomenclature and the numbering of the amino acid residues encompassed by each domain used throughout this disclosure is as described previously (Nishimasu 2014). The numbering of the amino acid residues is with reference to Cas9 from *S. pyogenes*.

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of *S. pyogenes* Cas9 (SEQ ID NO:2). The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of *S. pyogenes* Cas9 (SEQ ID NO:2). These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of *S. pyogenes* Cas9 (SEQ ID NO:2).

The NUC lobe comprises the RuvC domain, the HNH domain, and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvCI, RuvCII, and RuvCIII, which are often commonly referred to in the art as RuvCI domain or N-terminal RuvC domain, RuvCII domain, and RuvCIII domain, respectively) at amino acids 1-59, 718-769, and 909-1098, respectively, of *S. pyogenes* Cas9 (SEQ ID NO:2). Similar to the REC1 domain, the three RuvC motifs are linearly separated by other domains in the primary structure. However, in the tertiary structure, the three RuvC motifs assemble and form the RuvC domain. The HNH domain shares structural similarity with HNH endonucleases and cleaves a single strand, e.g., the complementary strand of the target nucleic acid molecule. The HNH domain lies between the RuvC II-III motifs and comprises amino acids 775-908 of *S. pyogenes* Cas9 (SEQ ID NO:2). The PI domain interacts with the PAM of the target nucleic acid molecule, and comprises amino acids 1099-1368 of *S. pyogenes* Cas9 (SEQ ID NO:2).

RuvC-Like Domain and HNH-Like Domain

In certain embodiments, a Cas9 molecule or Cas9 polypeptide comprises an HNH-like domain and a RuvC-like domain, and in certain of these embodiments cleavage activity is dependent on the RuvC-like domain and the HNH-like domain. A Cas9 molecule or Cas9 polypeptide can comprise one or more of a RuvC-like domain and an HNH-like domain. In certain embodiments, a Cas9 molecule or Cas9 polypeptide comprises a RuvC-like domain, e.g., a RuvC-like domain described below, and/or an HNH-like domain, e.g., an HNH-like domain described below.

RuvC-Like Domains

In certain embodiments, a RuvC-like domain cleaves a single strand, e.g., the non-complementary strand of the target nucleic acid molecule. The Cas9 molecule or Cas9 polypeptide can include more than one RuvC-like domain (e.g., one, two, three or more RuvC-like domains). In certain embodiments, a RuvC-like domain is at least 5, 6, 7, 8 amino acids in length but not more than 20, 19, 18, 17, 16 or 15 amino acids in length. In certain embodiments, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, a Cas9 molecule or Cas9 polypeptide can comprise an N-terminal RuvC-like domain. Exemplary N-terminal RuvC-like domains are described below.

In certain embodiments, a Cas9 molecule or Cas9 polypeptide comprises an N-terminal RuvC-like domain comprising an amino acid sequence of Formula I:

$$D-X_1-G-X_2-X_3-X_4-X_5-G-X_6-X_7-X_8-X_9, \quad \text{(SEQ ID NO: 20)}$$

wherein $X_1$ is selected from I, V, M, L, and T (e.g., selected from I, V, and L);

$X_2$ is selected from T, I, V, S, N, Y, E, and L (e.g., selected from T, V, and I);

$X_3$ is selected from N, S, G, A, D, T, R, M, and F (e.g., A or N);

$X_4$ is selected from S, Y, N, and F (e.g., S);

$X_5$ is selected from V, I, L, C, T, and F (e.g., selected from V, I and L);

$X_6$ is selected from W, F, V, Y, S, and L (e.g., W);

$X_7$ is selected from A, S, C, V, and G (e.g., selected from A and S);

$X_8$ is selected from V, I, L, A, M, and H (e.g., selected from V, I, M and L); and $X_9$ is selected from any amino acid or is absent (e.g., selected from T, V, I, L, A, F, S, A, Y, M, and R, or, e.g., selected from T, V, I, L, and A).

In certain embodiments, the N-terminal RuvC-like domain differs from a sequence of SEQ ID NO:20 by as many as 1 but no more than 2, 3, 4, or 5 residues.

In certain embodiments, the N-terminal RuvC-like domain is cleavage competent. In other embodiments, the N-terminal RuvC-like domain is cleavage incompetent.

In certain embodiments, a Cas9 molecule or Cas9 polypeptide comprises an N-terminal RuvC-like domain comprising an amino acid sequence of Formula II:

$$D-X_1-G-X_2-X_3-S-X_5-G-X_6-X_7-X_8-X_9, \quad \text{(SEQ ID NO: 21)},$$

wherein $X_1$ is selected from I, V, M, L, and T (e.g., selected from I, V, and L);

$X_2$ is selected from T, I, V, S, N, Y, E, and L (e.g., selected from T, V, and I);

$X_3$ is selected from N, S, G, A, D, T, R, M and F (e.g., A or N);

$X_5$ is selected from V, I, L, C, T, and F (e.g., selected from V, I and L);

$X_6$ is selected from W, F, V, Y, S, and L (e.g., W);

$X_7$ is selected from A, S, C, V, and G (e.g., selected from A and S);

$X_8$ is selected from V, I, L, A, M, and H (e.g., selected from V, I, M and L); and $X_9$ is selected from any amino acid or is absent (e.g., selected from T, V, I, L, A, F, S, A, Y, M, and R or selected from e.g., T, V, I, L, and A).

In certain embodiments, the N-terminal RuvC-like domain differs from a sequence of SEQ ID NO:21 by as many as 1 but not more than 2, 3, 4, or 5 residues.

In certain embodiments, the N-terminal RuvC-like domain comprises an amino acid sequence of Formula III:

$$D-I-G-X_2-X_3-S-V-G-W-A-X_8-X_9, \quad \text{(SEQ ID NO: 22)}$$

wherein $X_2$ is selected from T, I, V, S, N, Y, E, and L (e.g., selected from T, V, and I);

$X_3$ is selected from N, S, G, A, D, T, R, M, and F (e.g., A or N);

$X_8$ is selected from V, I, L, A, M, and H (e.g., selected from V, I, M and L); and $X_9$ is selected from any amino acid or is absent (e.g., selected from T, V, I, L, A, F, S, A, Y, M, and R or selected from e.g., T, V, I, L, and A).

In certain embodiments, the N-terminal RuvC-like domain differs from a sequence of SEQ ID NO:22 by as many as 1 but not more than, 2, 3, 4, or 5 residues.

In certain embodiments, the N-terminal RuvC-like domain comprises an amino acid sequence of Formula IV:

$$D-I-G-T-N-S-V-G-W-A-V-X, \quad \text{(SEQ ID NO: 23)}$$

wherein

X is a non-polar alkyl amino acid or a hydroxyl amino acid, e.g., X is selected from V, I, L, and T (e.g., the Cas9 molecule can comprise an N-terminal RuvC-like domain shown in FIGS. 2A-2G (depicted as Y)).

In certain embodiments, the N-terminal RuvC-like domain differs from a sequence of SEQ ID NO:23 by as many as 1 but not more than, 2, 3, 4, or 5 residues.

In certain embodiments, the N-terminal RuvC-like domain differs from a sequence of an N-terminal RuvC like domain disclosed herein, e.g., in FIGS. 3A-3B, as many as 1 but no more than 2, 3, 4, or 5 residues. In an embodiment, 1, 2, 3 or all of the highly conserved residues identified in FIGS. 3A-3B are present.

In certain embodiments, the N-terminal RuvC-like domain differs from a sequence of an N-terminal RuvC-like domain disclosed herein, e.g., in FIGS. 4A-4B, as many as 1 but no more than 2, 3, 4, or 5 residues. In an embodiment, 1, 2, or all of the highly conserved residues identified in FIGS. 4A-4B are present.

Additional RuvC-Like Domains

In addition to the N-terminal RuvC-like domain, the Cas9 molecule or Cas9 polypeptide can comprise one or more additional RuvC-like domains. In certain embodiments, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence of Formula V:

$$I-X_1-X_2-E-X_3-A-R-E, \quad \text{(SEQ ID NO: 15)}$$

wherein $X_1$ is V or H;

$X_2$ is I, L or V (e.g., I or V); and $X_3$ is M or T.

In certain embodiments, the additional RuvC-like domain comprises an amino acid sequence of Formula VI:

$$\text{I-V-X}_2\text{-E-M-A-R-E,} \quad \text{(SEQ ID NO: 16)}$$

wherein $X_2$ is I, L or V (e.g., I or V) (e.g., the Cas9 molecule or Cas9 polypeptide can comprise an additional RuvC-like domain shown in FIG. 2A-2G (depicted as B)).

An additional RuvC-like domain can comprise an amino acid sequence of Formula VII:

$$\text{H-H-A-X}_1\text{-D-A-X}_2\text{-X}_3, \quad \text{(SEQ ID NO: 17)}$$

wherein $X_1$ is H or L;
$X_2$ is R or V; and
$X_3$ is E or V.

In certain embodiments, the additional RuvC-like domain comprises the amino acid sequence: H—H-A-H-D-A-Y-L (SEQ ID NO: 18).

In certain embodiments, the additional RuvC-like domain differs from a sequence of SEQ ID NOs:15-18 by as many as 1 but not more than 2, 3, 4, or 5 residues.

In certain embodiments, the sequence flanking the N-terminal RuvC-like domain has the amino acid sequence of Formula VIII:

$$\text{K-X}_1'\text{-Y-X}_2'\text{-X}_3'\text{-X}_4'\text{-Z-T-D-X}_9'\text{-Y,} \quad \text{(SEQ ID NO: 19)}$$

wherein $X_1'$ is selected from K and P;
$X_2'$ is selected from V, L, I, and F (e.g., V, I and L);
$X_3'$ is selected from G, A and S (e.g., G);
$X_4'$ is selected from L, I, V, and F (e.g., L);
$X_9'$ is selected from D, E, N, and Q; and
Z is an N-terminal RuvC-like domain, e.g., as described above.

HNH-Like Domains

In certain embodiments, an HNH-like domain cleaves a single stranded complementary domain, e.g., a complementary strand of a double stranded nucleic acid molecule. In certain embodiments, an HNH-like domain is at least 15, 20, or 25 amino acids in length but not more than 40, 35, or 30 amino acids in length, e.g., 20 to 35 amino acids in length, e.g., 25 to 30 amino acids in length. Exemplary HNH-like domains are described below.

In an embodiment, a Cas9 molecule or Cas9 polypeptide comprises an HNH-like domain having an amino acid sequence of Formula IX:

$$\text{X}_1\text{-X}_2\text{-X}_3\text{-H-X}_4\text{-X}_5\text{-P-X}_6\text{-X}_7\text{-X}_8\text{-X}_9\text{-X}_{10}\text{-X}_{11}\text{-X}_{12}\text{-X}_{13}\text{-X}_{14}\text{-X}_{15}\text{-N-X}_{16}\text{-X}_{17}\text{-X}_{18}\text{-X}_{19}\text{-X}_{20}\text{-X}_{21}\text{-X}_{22}\text{-X}_{23}\text{-N,} \quad \text{(SEQ ID NO: 25)}$$

wherein $X_1$ is selected from D, E, Q, and N (e.g., D and E);
$X^2$ is selected from L, I, R, Q, V, M, and K;
$X_3$ is selected from D and E;
$X_4$ is selected from I, V, T, A, and L (e.g., A, I, and V);
$X_5$ is selected from V, Y, I, L, F, and W (e.g., V, I, and L);
$X_6$ is selected from Q, H, R, K, Y, I, L, F, and W;
$X_7$ is selected from S, A, D, T, and K (e.g., S and A);
$X_8$ is selected from F, L, V, K, Y, M, I, R, A, E, D, and Q (e.g., F);
$X_9$ is selected from L, R, T, I, V, S, C, Y, K, F, and G;
$X_{10}$ is selected from K, Q, Y, T, F, L, W, M, A, E, G, and S;
$X_{11}$ is selected from D, S, N, R, L, and T (e.g., D);
$X_{12}$ is selected from D, N and S;
$X_{13}$ is selected from S, A, T, G, and R (e.g., S);
$X_{14}$ is selected from I, L, F, S, R, Y, Q, W, D, K, and H (e.g., I, L, and F);
$X_{15}$ is selected from D, S, I, N, E, A, H, F, L, Q, M, G, Y, and V;
$X_{16}$ is selected from K, L, R, M, T, and F (e.g., L, R, and K);
$X_{17}$ is selected from V, L, I, A, and T;
$X_{18}$ is selected from L, I, V, and A (e.g., L and I);
$X_{19}$ is selected from T, V, C, E, S, and A (e.g., T and V);
$X_{20}$ is selected from R, F, T, W, E; L, N, C, K, V, S, Q, I, Y, H, and A;
$X_{21}$ is selected from S, P, R, K, N, A, H, Q, G, and L;
$X_{22}$ is selected from D, G, T, N, S, K, A, I, E, L, Q, R, and Y; and
$X_{23}$ is selected from K, V, A, E, Y, I, C, L, S, T, G, K, M, D, and F.

In certain embodiments, a HNH-like domain differs from a sequence of SEQ ID NO:25 by at least one but not more than, 2, 3, 4, or 5 residues.

In certain embodiments, the HNH-like domain is cleavage competent. In other embodiments, the HNH-like domain is cleavage incompetent.

In certain embodiments, a Cas9 molecule or Cas9 polypeptide comprises an HNH-like domain comprising an amino acid sequence of Formula X:

$$\text{X}_1\text{-X}_2\text{-X}_3\text{-H-X}_4\text{-X}_5\text{-P-X}_6\text{-S-X}_8\text{-X}_9\text{-X}_{10}\text{-D-D-S-X}_{14}\text{-X}_{15}\text{-N-K-V-L-X}_{19}\text{-X}_{20}\text{-X}_{21}\text{-X}_{22}\text{-X}_{23}\text{-N,} \quad \text{(SEQ ID NO: 26)}$$

wherein $X_1$ is selected from D and E;
$X_2$ is selected from L, I, R, Q, V, M, and K;
$X_3$ is selected from D and E;
$X_4$ is selected from I, V, T, A, and L (e.g., A, I, and V);
$X_5$ is selected from V, Y, I, L, F, and W (e.g., V, I, and L);
$X_6$ is selected from Q, H, R, K, Y, I, L, F, and W;
$X_8$ is selected from F, L, V, K, Y, M, I, R, A, E, D, and Q (e.g., F);
$X_9$ is selected from L, R, T, I, V, S, C, Y, K, F, and G;
$X_{10}$ is selected from K, Q, Y, T, F, L, W, M, A, E, G, and S;
$X_{14}$ is selected from I, L, F, S, R, Y, Q, W, D, K, and H (e.g., I, L, and F);
$X_{15}$ is selected from D, S, I, N, E, A, H, F, L, Q, M, G, Y, and V;
$X_{19}$ is selected from T, V, C, E, S, and A (e.g., T and V);
$X_{20}$ is selected from R, F, T, W, E, L, N, C, K, V, S, Q, I, Y, H, and A;
$X_{21}$ is selected from S, P, R, K, N, A, H, Q, G, and I;
$X_{22}$ is selected from D, G, T, N, S, K, A, I, E, L, Q, R, and Y; and
$X_{23}$ is selected from K, V, A, E, Y, I, C, L, S, T, G, K, M, D, and F.

In certain embodiments, the HNH-like domain differs from a sequence of SEQ ID NO:26 by 1, 2, 3, 4, or 5 residues.

In certain embodiments, a Cas9 molecule or Cas9 polypeptide comprises an HNH-like domain comprising an amino acid sequence of Formula XI:

(SEQ ID NO: 27)
$X_1$-V-$X_3$-H-I-V-P-$X_6$-S-$X_8$-$X_9$-$X_{10}$-D-D-S-$X_{14}$-$X_{15}$-N-
K-V-L-T-$X_{20}$-$X_{21}$-$X_{22}$-$X_{23}$-N, wherein
$X_1$ is selected from D and E;
$X_3$ is selected from D and E;
$X_6$ is selected from Q, H, R, K, Y, I, L, and W;
$X_8$ is selected from F, L, V, K, Y, M, I, R, A, E, D, and Q (e.g., F);
$X_9$ is selected from L, R, T, I, V, S, C, Y, K, F, and G;
$X_{10}$ is selected from K, Q, Y, T, F, L, W, M, A, E, G, and S;
$X_{14}$ is selected from I, L, F, S, R, Y, Q, W, D, K, and H (e.g., I, L, and F);
$X_{15}$ is selected from D, S, I, N, E, A, H, F, L, Q, M, G, Y, and V;
$X_{20}$ is selected from R, F, T, W, E, L, N, C, K, V, S, Q, I, Y, H, and A;
$X_{21}$ is selected from S, P, R, K, N, A, H, Q, G, and L;
$X_{22}$ is selected from D, G, T, N, S, K, A, I, E, L, Q, R, and Y; and
$X_{23}$ is selected from K, V, A, E, Y, I, C, L, S, T, G, K, M, D, and F.

In certain embodiments, the HNH-like domain differs from a sequence of SEQ ID NO:27 by 1, 2, 3, 4, or 5 residues.

In certain embodiments, a Cas9 molecule or Cas9 polypeptide comprises an HNH-like domain having an amino acid sequence of Formula XII:

(SEQ ID NO: 28)
D-$X_2$-D-H-I-$X_5$-P-Q-$X_7$-F-$X_9$-$X_{10}$-D-$X_{12}$-S-I-D-N-$X_{16}$-
V-L-$X_{19}$-$X_{20}$-S-$X_{22}$-$X_{23}$-N, wherein
$X_2$ is selected from I and V;
$X_5$ is selected from I and V;
$X_7$ is selected from A and S;
$X_9$ is selected from I and L;
$X_{10}$ is selected from K and T;
$X_{12}$ is selected from D and N;
$X_{16}$ is selected from R, K, and L;
$X_{19}$ is selected from T and V;
$X_{20}$ is selected from S, and R;
$X_{22}$ is selected from K, D, and A; and
$X_{23}$ is selected from E, K, G, and N (e.g., the Cas9 molecule or Cas9 polypeptide can comprise an HNH-like domain as described herein).

In an embodiment, the HNH-like domain differs from a sequence of SEQ ID NO:28 by as many as 1 but no more than 2, 3, 4, or 5 residues.

In certain embodiments, a Cas9 molecule or Cas9 polypeptide comprises the amino acid sequence of Formula XIII:

(SEQ ID NO: 24)
L-Y-Y-L-Q-N-G-$X_1$'-D-M-Y-$X_2$'-$X_3$'-$X_4$'-$X_5$'-L-D-I-
$X_6$'-$X_7$'-L-S-$X_8$'-Y-Z-N-R-$X_9$'-K-$X_{10}$'-D-$X_{11}$'-V-P, wherein
$X_1$' is selected from K and R;
$X_2$' is selected from V and T;
$X_3$' is selected from G and D;
$X_4$' is selected from E, Q and D;
$X_5$' is selected from E and D;
$X_6$' is selected from D, N, and H;
$X_7$' is selected from Y, R, and N;
$X_8$' is selected from Q, D, and N;
$X_9$' is selected from G and E;
$X_{10}$' is selected from S and G;
$X_{11}$' is selected from D and N; and
Z is an HNH-like domain, e.g., as described above.

In certain embodiments, the Cas9 molecule or Cas9 polypeptide comprises an amino acid sequence that differs from a sequence of SEQ ID NO:24 by as many as 1 but not more than 2, 3, 4, or 5 residues.

In certain embodiments, the HNH-like domain differs from a sequence of an HNH-like domain disclosed herein, e.g., in FIGS. 5A-5C, by as many as 1 but not more than 2, 3, 4, or 5 residues. In certain embodiments, 1 or both of the highly conserved residues identified in FIGS. 5A-5C are present.

In certain embodiments, the HNH-like domain differs from a sequence of an HNH-like domain disclosed herein, e.g., in FIGS. 6A-6B, by as many as 1 but not more than 2, 3, 4, or 5 residues. In an embodiment, 1, 2, or all 3 of the highly conserved residues identified in FIGS. 6A-6B are present.

Cas9 Activities

In certain embodiments, the Cas9 molecule or Cas9 polypeptide is capable of cleaving a target nucleic acid molecule. Typically, wild-type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide.

In certain embodiments, an eaCas9 molecule or eaCas9 polypeptide comprises one or more of the following enzymatic activities:

(1) nickase activity, i.e., the ability to cleave a single strand, e.g., the non-complementary strand or the complementary strand, of a nucleic acid molecule;

(2) double stranded nuclease activity, i.e., the ability to cleave both strands of a double stranded nucleic acid and create a double stranded break, which in an embodiment is the presence of two nickase activities;

(3) endonuclease activity;

(4) exonuclease activity; and (5) helicase activity, i.e., the ability to unwind the helical structure of a double stranded nucleic acid.

In certain embodiments, an eaCas9 molecule or eaCas9 polypeptide cleaves both DNA strands and results in a double stranded break. In certain embodiments, an eaCas9 molecule or eaCas9 polypeptide cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH domain. In an embodiment, an eaCas9 molecule or eaCas9 polypeptide comprises cleavage activity associated with a RuvC domain. In an embodiment, an eaCas9 molecule or eaCas9 polypeptide comprises cleavage activity associated with an HNH domain and cleavage activity associated with a RuvC domain. In an embodiment, an eaCas9 molecule or eaCas9 polypeptide comprises an active, or cleavage competent, HNH domain and an inactive, or cleavage incompetent, RuvC domain. In an embodiment, an eaCas9 molecule or eaCas9 polypeptide comprises an inactive, or cleavage incompetent, HNH domain and an active, or cleavage competent, RuvC domain.

Targeting and PAMs

A Cas9 molecule or Cas9 polypeptide can interact with a gRNA molecule and, in concert with the gRNA molecule, localize to a site which comprises a target domain, and in certain embodiments, a PAM sequence.

In certain embodiments, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. EaCas9 molecules from different bacterial species can recognize different sequence motifs (e.g., PAM sequences). In an embodiment, an eaCas9 molecule of S. pyogenes recognizes the sequence motif NGG and directs cleavage of a target nucleic acid sequence 1 to 10, e.g., 3 to 5, bp upstream from that sequence (see, e.g., Mali 2013). In an embodiment, an eaCas9 molecule of S. thermophilus recognizes the sequence motif NGGNG (SEQ ID NO: 199) and/or NNAGAAW (N=any nucleotide, W=A or T) (SEQ ID NO:200) and directs cleavage of a target nucleic acid sequence 1 to 10, e.g., 3 to 5, bp upstream from these sequences (see, e.g., Horvath 2010; Deveau 2008). In an embodiment, an eaCas9 molecule of S. mutans recognizes the sequence motif NGG and/or NAAR (R=A or G) (SEQ ID NO:201) and directs cleavage of a target nucleic acid sequence 1 to 10, e.g., 3 to 5 bp, upstream from this sequence (see, e.g., Deveau 2008). In an embodiment, an eaCas9 molecule of S. aureus recognizes the sequence motif NNGRR (R=A or G) (SEQ ID NO:202) and directs cleavage of a target nucleic acid sequence 1 to 10, e.g., 3 to 5, bp upstream from that sequence. In an embodiment, an eaCas9 molecule of S. aureus recognizes the sequence motif NNGRRN (R=A or G) (SEQ ID NO:203) and directs cleavage of a target nucleic acid sequence 1 to 10, e.g., 3 to 5, bp upstream from that sequence. In an embodiment, an eaCas9 molecule of S. aureus recognizes the sequence motif NNGRRT (R=A or G) (SEQ ID NO:204) and directs cleavage of a target nucleic acid sequence 1 to 10, e.g., 3 to 5, bp upstream from that sequence. In an embodiment, an eaCas9 molecule of S. aureus recognizes the sequence motif NNGRRV (R=A or G, V=A, G, or C) (SEQ ID NO:205) and directs cleavage of a target nucleic acid sequence 1 to 10, e.g., 3 to 5, bp upstream from that sequence. The ability of a Cas9 molecule to recognize a PAM sequence can be determined, e.g., using a transformation assay as described previously (Jinek 2012). In each of the aforementioned embodiments (i.e., SEQ ID NOs:199-205), N can be any nucleotide residue, e.g., any of A, G, C, or T.

As is discussed herein, Cas9 molecules can be engineered to alter the PAM specificity of the Cas9 molecule.

Exemplary naturally occurring Cas9 molecules have been described previously (see, e.g., Chylinski 2013). Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: S. aureus, S. pyogenes (e.g., strains SF370, MGAS10270, MGAS10750, MGAS2096, MGAS315, MGAS5005, MGAS6180, MGAS9429, NZ131, SSI-1), S. thermophilus (e.g., strain LMD-9), S. pseudoporcinus (e.g., strain SPIN 20026), S. mutans (e.g., strains UA159, NN2025), S. macacae (e.g., strain NCTC11558), S. gallolyticus (e.g., strains UCN34, ATCC BAA-2069), S. equines (e.g., strains ATCC 9812, MGCS 124), S. dysdalactiae (e.g., strain GGS 124), S. bovis (e.g., strain ATCC 700338), S. anginosus (e.g., strain F0211), S. agalactiae (e.g., strains NEM316, A909), Listeria monocytogenes (e.g., strain F6854), Listeria innocua (L. innocua, e.g., strain Clip11262), Enterococcus italicus (e.g., strain DSM 15952), or Enterococcus faecium (e.g., strain 1,231,408).

In certain embodiments, a Cas9 molecule or Cas9 polypeptide comprises an amino acid sequence:

having 60%, 65%, 70%, 75%, 80%, 85%, 90%, 95%, 96%, 97%, 98%, or 99% homology with;

differs at no more than, 2, 5, 10, 15, 20, 30, or 40% of the amino acid residues when compared with;

differs by at least 1, 2, 5, 10, or 20 amino acids, but by no more than 100, 80, 70, 60, 50, 40, or 30 amino acids from; or identical to any Cas9 molecule sequence described herein, or to a naturally occurring Cas9 molecule sequence, e.g., a Cas9 molecule from a species listed herein (e.g., SEQ ID NOs:1, 2, 4-6, or 12) or described in Chylinski 2013. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

In certain embodiments, a Cas9 molecule or Cas9 polypeptide comprises any of the amino acid sequence of the consensus sequence of FIGS. 2A-2G, wherein "*" indicates any amino acid found in the corresponding position in the amino acid sequence of a Cas9 molecule of S. pyogenes, S. thermophilus, S. mutans, or L. innocua, and "-" indicates absent. In an embodiment, a Cas9 molecule or Cas9 polypeptide differs from the sequence of the consensus sequence disclosed in FIGS. 2A-2G by at least 1, but no more than 2, 3, 4, 5, 6, 7, 8, 9, or 10 amino acid residues. In certain embodiments, a Cas9 molecule or Cas9 polypeptide comprises the amino acid sequence of SEQ ID NO:2. In other embodiments, a Cas9 molecule or Cas9 polypeptide differs from the sequence of SEQ ID NO:2 by at least 1, but no more than 2, 3, 4, 5, 6, 7, 8, 9, or 10 amino acid residues.

A comparison of the sequence of a number of Cas9 molecules indicate that certain regions are conserved. These are identified below as:
  region 1 (residues 1 to 180, or in the case of region 1' residues 120 to 180)
  region 2 (residues 360 to 480);
  region 3 (residues 660 to 720);
  region 4 (residues 817 to 900); and
  region 5 (residues 900 to 960).

In certain embodiments, a Cas9 molecule or Cas9 polypeptide comprises regions 1-5, together with sufficient additional Cas9 molecule sequence to provide a biologically active molecule, e.g., a Cas9 molecule having at least one activity described herein. In certain embodiments, regions 1-5 each independently have 50%, 60%, 70%, 80%, 85%, 90%, 95%, 96%, 97%, 98%, or 99% homology with the corresponding residues of a Cas9 molecule or Cas9 polypeptide described herein, e.g., a sequence from FIGS. 2A-2G (SEQ ID NOs: 1, 2, 4, 5, 14).

In certain embodiments, a Cas9 molecule or Cas9 polypeptide comprises an amino acid sequence referred to as region 1:
  having 50%, 60%, 70%, 80%, 85%, 90%, 95%, 96%, 97%, 98%, or 99% homology with amino acids 1-180 (the numbering is according to the motif sequence in FIG. 2; 52% of residues in the four Cas9 sequences in FIGS. 2A-2G are conserved) of the amino acid sequence of Cas9 of S. pyogenes (SEQ ID NO:2);
  differs by at least 1, 2, 5, 10 or 20 amino acids but by no more than 90, 80, 70, 60, 50, 40, or 30 amino acids from amino acids 1-180 of the amino acid sequence of Cas9 of S. pyogenes, S. thermophilus, S. mutans, or Listeria innocua (SEQ ID NOs:2, 4, 1, and 5, respectively); or
  is identical to amino acids 1-180 of the amino acid sequence of Cas9 of S. pyogenes, S. thermophilus, S. mutans, or L. innocua (SEQ ID NOs:2, 4, 1, and 5, respectively).

In certain embodiments, a Cas9 molecule or Cas9 polypeptide comprises an amino acid sequence referred to as region 1':
  having 55%, 60%, 65%, 70%, 75%, 80%, 85%, 90%, 95%, 96%, 97%, 98%, or 99% homology with amino acids 120-180 (55% of residues in the four Cas9 sequences in FIG. 2 are conserved) of the amino acid sequence of Cas9 of S. pyogenes, S. thermophilus, S. mutans, or L. innocua (SEQ ID NOs:2, 4, 1, and 5, respectively);
  differs by at least 1, 2, or 5 amino acids but by no more than 35, 30, 25, 20, or 10 amino acids from amino acids 120-180 of the amino acid sequence of Cas9 of S. pyogenes, S. thermophilus, S. mutans, or L. innocua (SEQ ID NOs:2, 4, 1, and 5, respectively); or
  is identical to amino acids 120-180 of the amino acid sequence of Cas9 of S. pyogenes, S. thermophilus, S. mutans, or L. innocua (SEQ ID NOs:2, 4, 1, and 5, respectively).

In certain embodiments, a Cas9 molecule or Cas9 polypeptide comprises an amino acid sequence referred to as region 2:
  having 50%, 55%, 60%, 65%, 70%, 75%, 80%, 85%, 90%, 95%, 96%, 97%, 98%, or 99% homology with amino acids 360-480 (52% of residues in the four Cas9 sequences in FIG. 2 are conserved) of the amino acid sequence of Cas9 of S. pyogenes, S. thermophilus, S. mutans, or L. innocua (SEQ ID NOs:2, 4, 1, and 5, respectively);
  differs by at least 1, 2, or 5 amino acids but by no more than 35, 30, 25, 20, or 10 amino acids from amino acids 360-480 of the amino acid sequence of Cas9 of S. pyogenes, S. thermophilus, S. mutans, or L. innocua (SEQ ID NOs:2, 4, 1, and 5, respectively); or
  is identical to amino acids 360-480 of the amino acid sequence of Cas9 of S. pyogenes, S. thermophilus, S. mutans, or L. innocua (SEQ ID NOs:2, 4, 1, and 5, respectively).

In certain embodiments, a Cas9 molecule or Cas9 polypeptide comprises an amino acid sequence referred to as region 3:
  having 55%, 60%, 65%, 70%, 75%, 80%, 85%, 90%, 95%, 96%, 97%, 98%, or 99% homology with amino acids 660-720 (56% of residues in the four Cas9 sequences in FIG. 2 are conserved) of the amino acid sequence of Cas9 of S. pyogenes, S. thermophilus, S. mutans, or L. innocua (SEQ ID NOs:2, 4, 1, and 5, respectively);
  differs by at least 1, 2, or 5 amino acids but by no more than 35, 30, 25, 20, or 10 amino acids from amino acids 660-720 of the amino acid sequence of Cas9 of S. pyogenes, S. thermophilus, S. mutans, or L. innocua (SEQ ID NOs:2, 4, 1, and 5, respectively); or
  is identical to amino acids 660-720 of the amino acid sequence of Cas9 of S. pyogenes, S. thermophilus, S. mutans, or L. innocua (SEQ ID NOs:2, 4, 1, and 5, respectively).

In certain embodiments, a Cas9 molecule or Cas9 polypeptide comprises an amino acid sequence referred to as region 4:
  having 50%, 55%, 60%, 65%, 70%, 75%, 80%, 85%, 90%, 95%, 96%, 97%, 98%, or 99% homology with amino acids 817-900 (55% of residues in the four Cas9 sequences in FIGS. 2A-2G are conserved) of the amino acid sequence of Cas9 of S. pyogenes, S. thermophilus, S. mutans, or L. innocua (SEQ ID NOs:2, 4, 1, and 5, respectively);
  differs by at least 1, 2, or 5 amino acids but by no more than 35, 30, 25, 20, or 10 amino acids from amino acids 817-900 of the amino acid sequence of Cas9 of S. pyogenes, S. thermophilus, S. mutans, or L. innocua (SEQ ID NOs:2, 4, 1, and 5, respectively); or
  is identical to amino acids 817-900 of the amino acid sequence of Cas9 of S. pyogenes, S. thermophilus, S. mutans, or L. innocua (SEQ ID NOs:2, 4, 1, and 5, respectively).

In certain embodiments, a Cas9 molecule or Cas9 polypeptide comprises an amino acid sequence referred to as region 5:
  having 50%, 55%, 60%, 65%, 70%, 75%, 80%, 85%, 90%, 95%, 96%, 97%, 98%, or 99% homology with amino acids 900-960 (60% of residues in the four Cas9 sequences in FIGS. 2A-2G are conserved) of the amino acid sequence of Cas9 of *S. pyogenes, S. thermophilus, S. mutans*, or *L. innocua* (SEQ ID NOs:2, 4, 1, and 5, respectively);

differs by at least 1, 2, or 5 amino acids but by no more than 35, 30, 25, 20, or 10 amino acids from amino acids 900-960 of the amino acid sequence of Cas9 of *S. pyogenes, S. thermophilus, S. mutans*, or *L. innocua* (SEQ ID NOs:2, 4, 1, and 5, respectively); or is identical to amino acids 900-960 of the amino acid sequence of Cas9 of *S. pyogenes, S. thermophilus, S. mutans*, or *L. innocua* (SEQ ID NOs:2, 4, 1, and 5, respectively).

Engineered or Altered Cas9

Cas9 molecules and Cas9 polypeptides described herein can possess any of a number of properties, including nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In certain embodiments, a Cas9 molecule or Cas9 polypeptide can include all or a subset of these properties. In a typical embodiment, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity (as compared with a naturally occurring or other reference Cas9 molecule) or altered helicase activity. As discussed herein, an engineered Cas9 molecule or Cas9 polypeptide can have nickase activity (as opposed to double strand nuclease activity). In certain embodiments, an engineered Cas9 molecule or Cas9 polypeptide can have an alteration that alters its size, e.g., a deletion of amino acid sequence that reduces its size, e.g., without significant effect on one or more Cas9 activities. In certain embodiments, an engineered Cas9 molecule or Cas9 polypeptide can comprise an alteration that affects PAM recognition, e.g., an engineered Cas9 molecule can be altered to recognize a PAM sequence other than that recognized by the endogenous wild-type PI domain. In certain embodiments, a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring, Cas9 molecules or Cas9 polypeptides, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In an embodiment, a Cas9 molecule or Cas9 polypeptide can comprises one or more mutations or differences, e.g., at least 1, 2, 3, 4, 5, 10, 15, 20, 30, 40, or 50 mutations but less than 200, 100, or 80 mutations relative to a reference, e.g., a parental, Cas9 molecule.

In certain embodiments, a mutation or mutations do not have a substantial effect on a Cas9 activity, e.g., a Cas9 activity described herein. In other embodiments, a mutation or mutations have a substantial effect on a Cas9 activity, e.g., a Cas9 activity described herein.

Non-Cleaving and Modified-Cleavage Cas9

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

In certain embodiments, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In certain embodiments, an eaCas9 molecule or eaCas9 polypeptide comprises an active, or cleavage competent, HNH-like domain (e.g., an HNH-like domain described herein, e.g., SEQ ID NOs:24-28) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 9 of the consensus sequence disclosed in FIGS. 2A-2G or an aspartic acid at position 10 of SEQ ID NO:2, e.g., can be substituted with an alanine. In an embodiment, the eaCas9 molecule or eaCas9 polypeptide differs from wild-type in the N-terminal RuvC-like domain and does not cleave the target nucleic acid, or cleaves with significantly less efficiency, e.g., less than 20, 10, 5, 1, or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes*, or *S. thermophilus*. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain (e.g., a RuvC-like domain described herein, e.g., SEQ ID NOs: 15-23). Exemplary inactive, or cleavage incompetent HNH-like domains can have a mutation at one or more of: a histidine in an HNH-like domain, e.g., a histidine shown at position 856 of the consensus sequence disclosed in FIGS. 2A-2G, e.g., can be substituted with an alanine; and one or more asparagines in an HNH-like domain, e.g., an asparagine shown at position 870 of the consensus sequence disclosed in FIGS.

2A-2G and/or at position 879 of the consensus sequence disclosed in FIGS. 2A-2G, e.g., can be substituted with an alanine. In an embodiment, the eaCas9 differs from wild-type in the HNH-like domain and does not cleave the target nucleic acid, or cleaves with significantly less efficiency, e.g., less than 20, 10, 5, 1, or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes or S. thermophilus. In an embodiment, the reference Cas9 molecule is the naturally occurring Cas9 molecule having the closest sequence identity or homology.

In certain embodiments, exemplary Cas9 activities comprise one or more of PAM specificity, cleavage activity, and helicase activity. A mutation(s) can be present, e.g., in: one or more RuvC domains, e.g., an N-terminal RuvC domain; an HNH domain; a region outside the RuvC domains and the HNH domain. In an embodiment, a mutation(s) is present in a RuvC domain. In an embodiment, a mutation(s) is present in an HNH domain. In an embodiment, mutations are present in both a RuvC domain and an HNH domain.

Exemplary mutations that may be made in the RuvC domain or HNH domain with reference to the S. pyogenes sequence include: D10A, E762A, H840A, N854A, N863A, and/or D986A.

Whether or not a particular sequence, e.g., a substitution, may affect one or more activity, such as targeting activity, cleavage activity, etc., can be evaluated or predicted, e.g., by evaluating whether the mutation is conservative. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule comprises a cleavage property that differs from naturally occurring Cas9 molecules, e.g., that differs from the naturally occurring Cas9 molecule having the closest homology. For example, a Cas9 molecule can differ from naturally occurring Cas9 molecules, e.g., a Cas9 molecule of S. aureus, S. pyogenes, or C. jejuni as follows: its ability to modulate, e.g., decreased or increased, cleavage of a double stranded break (endonuclease and/or exonuclease activity), e.g., as compared to a naturally occurring Cas9 molecule (e.g., a Cas9 molecule of S. aureus, S. pyogenes, or C. jejuni); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of S. aureus, S. pyogenes, or C. jejuni); or the ability to cleave a nucleic acid molecule, e.g., a double stranded or single stranded nucleic acid molecule, can be eliminated.

In an embodiment, the altered Cas9 molecule is an eaCas9 molecule comprising one or more of the following activities: cleavage activity associated with a RuvC domain; cleavage activity associated with an HNH domain; cleavage activity associated with an HNH domain and cleavage activity associated with a RuvC domain.

In certain embodiments, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G; and the sequence corresponding to the residues identified by "*" in the consensus sequence disclosed in FIGS. 2A-2G differs at no more than 1, 2, 3, 4, 5, 10, 15, 20, 25, 30, 35, or 40% of the "*" residues from the corresponding sequence of naturally occurring Cas9 molecule, e.g., an S. pyogenes, S. thermophilus, S. mutans, or L. innocua Cas9 molecule.

In an embodiment, the altered Cas9 molecule or Cas9 polypeptide is an eaCas9 molecule or eaCas9 polypeptide comprising the amino acid sequence of S. pyogenes Cas9 disclosed in FIGS. 2A-2G (SEQ ID NO:2) with one or more amino acids that differ from the sequence of S. pyogenes (e.g., substitutions) at one or more residues (e.g., 2, 3, 5, 10, 15, 20, 30, 50, 70, 80, 90, 100, or 200 amino acid residues) represented by an "*" in the consensus sequence disclosed in FIGS. 2A-2G (SEQ ID NO:14).

In an embodiment, the altered Cas9 molecule or Cas9 polypeptide is an eaCas9 molecule or eaCas9 polypeptide comprising the amino acid sequence of S. thermophilus Cas9 disclosed in FIGS. 2A-2G (SEQ ID NO:4) with one or more amino acids that differ from the sequence of S. thermophilus (e.g., substitutions) at one or more residues (e.g., 2, 3, 5, 10, 15, 20, 30, 50, 70, 80, 90, 100, or 200 amino acid residues) represented by an "*" in the consensus sequence disclosed in FIGS. 2A-2G (SEQ ID NO:14).

In an embodiment, the altered Cas9 molecule or Cas9 polypeptide is an eaCas9 molecule or eaCas9 polypeptide comprising the amino acid sequence of S. mutans Cas9 disclosed in FIGS. 2A-2G (SEQ ID NO:1) with one or more amino acids that differ from the sequence of S. mutans (e.g., substitutions) at one or more residues (e.g., 2, 3, 5, 10, 15, 20, 30, 50, 70, 80, 90, 100, or 200 amino acid residues) represented by an "*" in the consensus sequence disclosed in FIGS. 2A-2G (SEQ ID NO:14).

In an embodiment, the altered Cas9 molecule or Cas9 polypeptide is an eaCas9 molecule or eaCas9 polypeptide comprising the amino acid sequence of L. innocua Cas9 disclosed in FIGS. 2A-2G (SEQ ID NO:5) with one or more amino acids that differ from the sequence of L. innocua (e.g., substitutions) at one or more residues (e.g., 2, 3, 5, 10, 15, 20, 30, 50, 70, 80, 90, 100, or 200 amino acid residues) represented by an "*" in the consensus sequence disclosed in FIGS. 2A-2G (SEQ ID NO:14).

In certain embodiments, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of S. pyogenes comprising an N-terminal RuvC-like domain can be fused to a fragment of Cas9 molecule of a species other than S. pyogenes (e.g., S. thermophilus) comprising an HNH-like domain.

Cas9 with Altered or No PAM Recognition

Naturally occurring Cas9 molecules can recognize specific PAM sequences, for example the PAM recognition sequences described above for, e.g., S. pyogenes, S. thermophilus, S. mutans, and S. aureus.

In certain embodiments, a Cas9 molecule or Cas9 polypeptide has the same PAM specificities as a naturally occurring Cas9 molecule. In other embodiments, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes in order to decrease off-target sites and/or improve specificity; or eliminate a PAM recognition requirement. In certain embodiments, a Cas9 molecule or Cas9 polypeptide can be altered, e.g., to increase length of PAM recognition sequence and/or improve Cas9 specificity to high level of identity (e.g., 98%, 99%, or 100% match between gRNA and a PAM sequence), e.g., to decrease off-target sites and/or increase specificity. In certain embodiments, the length of the PAM recognition sequence is at least 4, 5, 6, 7, 8, 9, 10, or 15 amino acids in length. In an embodiment, the Cas9 specificity requires at least 90%, 95%, 96%, 97%, 98%, 99% or more homology between the gRNA and the PAM sequence. Cas9 molecules or Cas9 polypeptides that recognize different PAM sequences and/or have reduced off-target activity can be generated using directed evolution. Exemplary methods and systems that can be used for directed evolution of Cas9 molecules are described (see, e.g., Esvelt 2011). Candidate Cas9 molecules can be evaluated, e.g., by methods described herein.

Size-Optimized Cas9

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a S. aureus, S. pyogenes, or C. jejuni, Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule can comprise one or more deletions that do not substantially affect or decrease the activity of the resultant Cas9 molecules described herein. Activities that are retained in the Cas9 molecules comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed in Table 1, can be modeled onto the crystal structure of S. pyogenes Cas9 (Nishimasu 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

Nucleic Acids Encoding Cas9 Molecules

Nucleic acids encoding the Cas9 molecules or Cas9 polypeptides, e.g., an eaCas9 molecule or eaCas9 polypeptides are provided herein. Exemplary nucleic acids encoding Cas9 molecules or Cas9 polypeptides have been described previously (see, e.g., Cong 2013; Wang 2013; Mali 2013; Jinek 2012).

In an embodiment, a nucleic acid encoding a Cas9 molecule or Cas9 polypeptide can be a synthetic nucleic acid sequence. For example, the synthetic nucleic acid molecule can be chemically modified, e.g., as described herein. In an embodiment, the Cas9 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

An exemplary codon optimized nucleic acid sequence encoding a Cas9 molecule of S. pyogenes is set forth in SEQ ID NO:3. The corresponding amino acid sequence of an S. pyogenes Cas9 molecule is set forth in SEQ ID NO:2.

An exemplary codon optimized nucleic acid sequence encoding a Cas9 molecule of S. aureus is set forth in SEQ ID NO:7. An amino acid sequence of an S. aureus Cas9 molecule is set forth in SEQ ID NO:6.

Provided below is an exemplary codon optimized nucleic acid sequence encoding a Cas9 molecule of S. aureus Cas9.

If any of the above Cas9 sequences are fused with a peptide or polypeptide at the C-terminus, it is understood that the stop codon will be removed.

Other Cas Molecules and Cas Polypeptides

Various types of Cas molecules or Cas polypeptides can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) have been described previously (see, e.g., Haft 2005 and Makarova 2011). Exemplary Cas molecules (and Cas systems) are also shown in Table 2.

Cpf1 Molecules

The crystal structure of Acidaminococcus sp. Cpf1 in complex with crRNA and a double-stranded (ds) DNA target including a TTTN PAM sequence has been solved by Yamano 2016, incorporated by reference herein. Cpf1, like Cas9, has two lobes: a REC (recognition) lobe, and a NUC (nuclease) lobe. The REC lobe includes REC1 and REC2 domains, which lack similarity to any known protein structures. The NUC lobe, meanwhile, includes three RuvC domains (RuvC-I, -II and -III) and a BH domain. However, in contrast to Cas9, the Cpf1 REC lobe lacks an HNH domain, and includes other domains that also lack similarity to known protein structures: a structurally unique PI domain, three Wedge (WED) domains (WED-I, -II and -III), and a nuclease (Nuc) domain.

While Cas9 and Cpf1 share similarities in structure and function, it should be appreciated that certain Cpf1 activities are mediated by structural domains that are not analogous to any Cas9 domains. For instance, cleavage of the complementary strand of the target DNA appears to be mediated by the Nuc domain, which differs sequentially and spatially from the HNH domain of Cas9. Additionally, the non-targeting portion of Cpf1 gRNA (the handle) adopts a pseudoknot structure, rather than a stem loop structure formed by the repeat:antirepeat duplex in Cas9 gRNAs.

Modifications of RNA-Guided Nucleases

The RNA-guided nucleases described above have activities and properties that can be useful in a variety of applications, but the skilled artisan will appreciate that RNA-guided nucleases can also be modified in certain instances, to alter cleavage activity, PAM specificity, or other structural or functional features.

Turning first to modifications that alter cleavage activity, mutations that reduce or eliminate the activity of domains within the NUC lobe have been described above. Exemplary mutations that may be made in the RuvC domains, in the Cas9 HNH domain, or in the Cpf1 Nuc domain are described in Ran 2013 and Yamano 2016, as well as in Cotta-Ramusino 2016. In general, mutations that reduce or eliminate activity in one of the two nuclease domains result in RNA-guided nucleases with nickase activity, but it should be noted that the type of nickase activity varies depending on which domain is inactivated. As one example, inactivation of a RuvC domain of a Cas9 will result in a nickase that cleaves the complementary or top strand as shown below (where C denotes the site of cleavage):

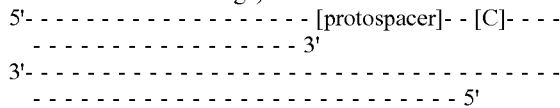

On the other hand, inactivation of a Cas9 HNH domain results in a nickase that cleaves the bottom or non-complementary strand:

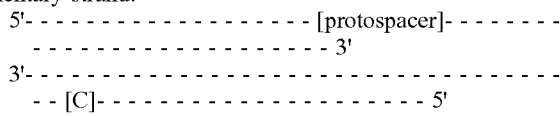

Modifications of PAM specificity relative to naturally occurring Cas9 reference molecules has been described by Kleinstiver 2015a for both *S. pyogenes* and *S. aureus* (Kleinstiver 2015b). Kleinstiver et al. have also described modifications that improve the targeting fidelity of Cas9 (Kleinstiver 2016). Each of these references is incorporated by reference herein.

RNA-guided nucleases have been split into two or more parts, as described by Zetsche 2015, incorporated by reference, and by Fine 2015, incorporated by reference.

RNA-guided nucleases can be, in certain embodiments, size-optimized or truncated, for instance via one or more deletions that reduce the size of the nuclease while still retaining gRNA association, target and PAM recognition, and cleavage activities. In certain embodiments, RNA-guided nucleases are bound, covalently or non-covalently, to another polypeptide, nucleotide, or other structure, optionally by means of a linker. Exemplary bound nucleases and linkers are described by Guilinger 2014, which is incorporated by reference for all purposes herein.

RNA-guided nucleases also optionally include a tag, such as, but not limited to, a nuclear localization signal to facilitate movement of RNA-guided nuclease protein into the nucleus. In certain embodiments, the RNA-guided nuclease can incorporate C- and/or N-terminal nuclear localization signals. Nuclear localization sequences are known in the art and are described in Maeder and elsewhere.

The foregoing list of modifications is intended to be exemplary in nature, and the skilled artisan will appreciate, in view of the instant disclosure, that other modifications may be possible or desirable in certain applications. For brevity, therefore, exemplary systems, methods and compositions of the present disclosure are presented with reference to particular RNA-guided nucleases, but it should be understood that the RNA-guided nucleases used may be modified in ways that do not alter their operating principles. Such modifications are within the scope of the present disclosure.

Nucleic Acids Encoding RNA-Guided Nucleases

Nucleic acids encoding RNA-guided nucleases, e.g., Cas9, Cpf1 or functional fragments thereof, are provided herein. Exemplary nucleic acids encoding RNA-guided nucleases have been described previously (see, e.g., Cong 2013; Wang 2013; Mali 2013; Jinek 2012).

In some cases, a nucleic acid encoding an RNA-guided nuclease can be a synthetic nucleic acid sequence. For example, the synthetic nucleic acid molecule can be chemically modified. In certain embodiments, an mRNA encoding an RNA-guided nuclease will have one or more (e.g., all) of the following properties: it can be capped; polyadenylated; and substituted with 5-methylcytidine and/or pseudouridine.

Synthetic nucleic acid sequences can also be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein. Examples of codon optimized Cas9 coding sequences are presented in Cotta-Ramusino 2016.

In addition, or alternatively, a nucleic acid encoding an RNA-guided nuclease may comprise a nuclear localization sequence (NLS). Nuclear localization sequences are known in the art.

Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule have been described previously (Jinek 2012).

Binding and Cleavase Assay: Testing the Endonuclease Activity of Cas9 Molecules

The ability of a Cas9 molecule/gRNA molecule complex to bind to and cleave a target nucleic acid can be evaluated in a plasmid cleavage assay. In this assay, a synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 minutes at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM MgCl$_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands, while nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [$\gamma$-$^{32}$P]-ATP in 1×T4 polynucleotide kinase reaction buffer at 37° C. for 30 minutes, in a 50 μL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 minutes, followed by slow cooling to room temperature. For cleavage assays, gRNA molecules are annealed by heating to 95° C. for 30 seconds, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 μL. Reactions are initiated by the addition of 1 μL target DNA (10 nM) and incubated for 1 hour at 37° C. Reactions are quenched by the addition of 20 μL of loading dye (5 mM EDTA, 0.025% SDS, 5% glycerol in formamide) and heated to 95° C. for 5 minutes. Cleavage products are resolved on 12% denaturing polyacrylamide gels containing 7 M urea and visualized by phosphorimaging. The resulting cleavage products indicate that whether the complementary strand, the non-complementary strand, or both are cleaved.

One or both of these assays can be used to evaluate the suitability of a candidate gRNA molecule or candidate Cas9 molecule.

Binding Assay: Testing the Binding of Cas9 Molecules to Target DNA

Exemplary methods for evaluating the binding of Cas9 molecules to target DNA have been described previously (Jinek 2012).

For example, in an electrophoretic mobility shift assay, target DNA duplexes are formed by mixing of each strand (10 nmol) in deionized water, heating to 95° C. for 3 minutes, and slow cooling to room temperature. All DNAs are purified on 8% native gels containing 1×TBE. DNA bands are visualized by UV shadowing, excised, and eluted by soaking gel pieces in DEPC-treated H$_2$O. Eluted DNA is ethanol precipitated and dissolved in DEPC-treated H$_2$O. DNA samples are 5' end labeled with [$\gamma$-$^{32}$P]-ATP using T4 polynucleotide kinase for 30 minutes at 37° C. Polynucleotide kinase is heat denatured at 65° C. for 20 minutes, and unincorporated radiolabel is removed using a column. Binding assays are performed in buffer containing 20 mM HEPES pH 7.5, 100 mM KCl, 5 mM MgCl$_2$, 1 mM DTT, and 10% glycerol in a total volume of 10 μL. Cas9 protein molecules are programmed with equimolar amounts of pre-annealed gRNA molecule and titrated from 100 pM to 1 μM. Radiolabeled DNA is added to a final concentration of 20 pM. Samples are incubated for 1 hour at 37° C. and resolved at 4° C. on an 8% native polyacrylamide gel containing IX TBE and 5 mM MgCl$_2$. Gels are dried and DNA visualized by phosphorimaging.

Differential Scanning Flourimetry (DSF)

The thermostability of Cas9-gRNA ribonucleoprotein (RNP) complexes can be measured via DSF. This technique measures the thermostability of a protein, which can increase under favorable conditions such as the addition of a binding RNA molecule, e.g., a gRNA.

The assay can be performed using two different protocols, one to test the best stoichiometric ratio of gRNA:Cas9 protein and another to determine the best solution conditions for RNP formation.

To determine the best solution conditions for forming RNP complexes, a 2 μM solution of Cas9 is made in water with 10× SYPRO Orange® (Life Technologies cat #S-6650) and dispensed into a 384 well plate. An equimolar amount of gRNA diluted in solutions with varied pH and salt is then added. After incubating at room temperature for 10 minutes and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

The second assay consists of mixing various concentrations of gRNA with 2 μM Cas9 in optimal buffer from assay 1 above, and incubating at room temperature for 10 minutes in a 384 well plate. An equal volume of optimal buffer and 10× SYPRO Orange® (Life Technologies cat #S-6650) is added and the plate is sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

HDR Repair, HDR-Mediated Knock-in, and Template Nucleic Acids

In certain embodiments of the methods provided herein, a mutation in the SERPINA1 gene is corrected by HDR using an exogenously provided template nucleic acid (also referred to herein as a donor construct). While not wishing to be bound by theory, it is believed that alteration of the target sequence occurs by HDR with an exogenously provided donor template or template nucleic acid. For example, the donor construct or template nucleic acid provides for alteration of an A1AT target position, e.g., an A1AT target point position. It is contemplated that a plasmid donor can be used as a template for homologous recombination. It is further contemplated that a single stranded donor template can be used as a template for alteration of a target sequence by alternate methods of HDR (e.g., single strand annealing) between the target sequence and the donor template. Donor template-effected alteration of an A1AT target position depends on cleavage by an RNA-guided nuclease (e.g., a Cas9 molecule). Cleavage by an RNA-guided nuclease (e.g., a Cas9 molecule) can comprise a double-strand break or two single-strand breaks.

In other embodiments, a mutation in the SERPINA1 gene is corrected by HDR without using an exogenously provided template nucleic acid. While not wishing to be bound by theory, it is believed that alteration of the A1AT target position occurs by HDR with an endogenous genomic donor sequence. For example, the endogenous genomic donor sequence provides for alteration of an A1AT target position, e.g., an A1AT target point position. It is contemplated that in an embodiment the endogenous genomic donor sequence is located on the same chromosome as the target sequence. It is further contemplated that in another embodiment the endogenous genomic donor sequence is located on a different chromosome from the target sequence. Alteration of an A1AT target position by endogenous genomic donor sequence depends on cleavage by an RNA-guided nuclease (e.g., a Cas9 molecule). Cleavage by an RNA-guided nuclease (e.g., a Cas9 molecule) can comprise a double-strand break or two single-strand breaks.

Mutations that can be corrected by HDR using a template nucleic acid, or using endogenous genomic donor sequence, include point mutations, e.g., a Z mutation or S mutation. In certain embodiments, a point mutation can be corrected using either one double-strand break or two single-strand breaks. In an embodiment, a point mutation can be corrected by (1) one double-strand break, (2) two single-strand breaks, (3) two double-strand breaks with a break occurring on each side of the target position, (4) one double-strand break and two single-strand breaks with the double-strand break and two single-strand breaks occurring on each side of the target position, (5) four single-strand breaks with a pair of single-strand breaks occurring on each side of the target position, or (6) one single-strand break.

In certain embodiments wherein a single-stranded template nucleic acid is used, the A1AT target position can be altered by alternative HDR.

Donor template-effected alteration of a target position depends on cleavage by an RNA-guided nuclease (e.g., a Cas9 molecule). Cleavage by an RNA-guided nuclease (e.g., Cas9) can comprise a break (e.g., a nick, a double-strand break, or two single-strand breaks), e.g., one on each strand of the target nucleic acid. After introduction of the breaks on the target nucleic acid, resection occurs at the break ends resulting in single stranded overhanging DNA regions.

In canonical HDR, a double-stranded donor template is introduced, comprising homologous sequence to the target nucleic acid that will either be directly incorporated into the target nucleic acid or used as a template to correct the sequence of the target nucleic acid. After resection at the break, repair can progress by different pathways, e.g., by the double Holliday junction model (or double strand break repair, DSBR, pathway) or the synthesis-dependent strand annealing (SDSA) pathway. In the double Holliday junction model, strand invasion by the two single stranded overhangs of the target nucleic acid to the homologous sequences in the donor template occurs, resulting in the formation of an intermediate with two Holliday junctions. The junctions migrate as new DNA is synthesized from the ends of the invading strand to fill the gap resulting from the resection. The end of the newly synthesized DNA is ligated to the resected end, and the junctions are resolved, resulting in the correction of the target nucleic acid, e.g., incorporation of the correct sequence of the donor template at the corresponding target position. Crossover with the donor template may occur upon resolution of the junctions. In the SDSA pathway, only one single stranded overhang invades the donor template and new DNA is synthesized from the end of the invading strand to fill the gap resulting from resection. The newly synthesized DNA then anneals to the remaining single stranded overhang, new DNA is synthesized to fill in the gap, and the strands are ligated to produce the corrected DNA duplex.

In alternative HDR, a single strand donor template, e.g., template nucleic acid, is introduced. A nick, single-strand break, or double-strand break at the target nucleic acid, for altering a desired A1AT target position, is mediated by an RNA-guided nuclease (e.g., a Cas9 molecule), e.g., described herein, and resection at the break occurs to reveal single stranded overhangs. Incorporation of the sequence of the template nucleic acid to correct or alter the target position of the target nucleic acid typically occurs by the SDSA pathway, as described above.

Additional details on template nucleic acids are provided in Section IV entitled "Template nucleic acids" in International Application PCT/US2014/057905.

In certain embodiments, double-strand cleavage is effected by an RNA-guided nuclease (e.g., a Cas9 molecule) having cleavage activity associated with an HNH-like domain and cleavage activity associated with a RuvC-like domain, e.g., an N-terminal RuvC-like domain, e.g., a wild-type Cas9. Such embodiments require only a single gRNA.

In certain embodiments, one single-strand break, or nick, is effected by an RNA-guided nuclease (e.g., a Cas9 molecule) having nickase activity, e.g., a Cas9 nickase as described herein. A nicked target nucleic acid can be a substrate for alt-HDR.

In other embodiments, two single-strand breaks, or nicks, are effected by an RNA-guided nuclease (e.g., a Cas9 molecule) having nickase activity, e.g., cleavage activity associated with an HNH-like domain or cleavage activity associated with an N-terminal RuvC-like domain. Such embodiments usually require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In certain embodiments, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HNH activity and will cut on the strand to which the gRNA hybridizes (e.g., the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA). In other embodiments, a Cas9 molecule having an N863 mutation, e.g., the N863A mutation, mutation can be used as a nickase. N863A inactivates HNH therefore the Cas9 nickase has (only) RuvC activity and cuts on the non-complementary strand (the strand that has the NGG PAM and whose sequence is identical to the gRNA).

In certain embodiments in which a nickase and two gRNAs are used to position two single strand nicks, one nick is on the + strand and one nick is on the − strand of the target nucleic acid. The PAMs can be outwardly facing. The gRNAs can be selected such that the gRNAs are separated by, from about 0-50, 0-100, or 0-200 nucleotides. In an embodiment, there is no overlap between the target sequences that are complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran 2013).

In certain embodiments, a single nick can be used to induce HDR, e.g., alt-HDR. It is contemplated herein that a single nick can be used to increase the ratio of HR to NHEJ at a given cleavage site. In an embodiment, a single-strand break is formed in the strand of the target nucleic acid to which the targeting domain of said gRNA is complementary. In other embodiments, a single-strand break is formed in the strand of the target nucleic acid other than the strand to which the targeting domain of said gRNA is complementary.

Placement of Double-Strand or Single-Strand Breaks Relative to the Target Position A double-strand break or single-strand break in one of the strands should be sufficiently close to an A1AT target position that an alteration is produced in the desired region, e.g., correction of a mutation occurs. In certain embodiments, the distance is not more than 50, 100, 200, 300, 350, or 400 nucleotides from the A1AT target position. While not wishing to be bound by theory, in certain embodiments it is believed that the break should be sufficiently close to the A1AT target position that the target position is within the region that is subject to exonuclease-mediated removal during end resection. If the distance between the target position and a break is too great, the mutation or other sequence desired to be altered may not be included in the end resection and, therefore, may not be corrected, as donor sequence, either exogenously provided donor sequence or endogenous genomic donor sequence, in some embodiments is only used to correct sequence within the end resection region.

In certain embodiments, the gRNA targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, or 200 nucleotides of the region desired to be altered, e.g., a mutation. The break, e.g., a double-strand or single-strand break, can be positioned upstream or downstream of the region desired to be altered, e.g., a mutation. In some embodiments, a break is positioned within the region desired to be altered, e.g., within a region defined by at least two mutant nucleotides. In some embodiments, a break is positioned immediately adjacent to the region desired to be altered, e.g., immediately upstream or downstream of a mutation.

In certain embodiments, a single-strand break is accompanied by an additional single-strand break, positioned by a second gRNA molecule, as discussed below. For example, the targeting domains bind configured such that a cleavage event, e.g., the two single-strand breaks, are positioned within 1, 2, 3, 4, 5, 10, 15, 20, 25, 30, 35, 40, 45, 50, 60, 70, 80, 90, 100, 150, or 200 nucleotides of an A1AT target position. In an embodiment, the first and second gRNA molecules are configured such that, when guiding a Cas9 nickase, a single-strand break will be accompanied by an additional single strand break, positioned by a second gRNA, sufficiently close to one another to result in alteration of the desired region. In an embodiment, the first and second gRNA molecules are configured such that a single-strand break positioned by said second gRNA is within 10, 20, 30, 40, or 50 nucleotides of the break positioned by said first gRNA molecule, e.g., when the Cas9 is a nickase. In an embodiment, the two gRNA molecules are configured to position cuts at the same position, or within a few nucleotides of one another, on different strands, e.g., essentially mimicking a double-strand break.

In certain embodiments in which a gRNA (unimolecular (or chimeric) or modular gRNA) and Cas9 nuclease induce a double-strand break for the purpose of inducing HDR-mediated correction, the cleavage site is 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the A1AT target position. In certain embodiments, the cleavage site is 0-100 bp (e.g., 0 to 75, 0 to 50, 0 to 25, 25 to 100, 25 to 75, 25 to 50, 50 to 100, 50 to 75 or 75 to 100 bp) away from the A1AT target position.

In certain embodiments, one can promote HDR by using nickases to generate a break with overhangs. While not wishing to be bound by theory, the single stranded nature of the overhangs can enhance the likelihood of a cell repairing the break by HDR as opposed to, e.g., NHEJ. Specifically, in some embodiments, HDR is promoted by selecting a first gRNA that targets a first nickase to a first target sequence, and a second gRNA that targets a second nickase to a second target sequence which is on the opposite DNA strand from the first target sequence and offset from the first nick.

In certain embodiments, the targeting domain of a gRNA molecule is configured to position a cleavage event sufficiently far from a preselected nucleotide, e.g., the nucleotide of a coding region, that the nucleotide is not altered. In certain embodiments, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

Placement of a First Break and a Second Break Relative to Each Other

In certain embodiments, a double-strand break can be accompanied by an additional double-strand break, positioned by a second gRNA molecule, as is discussed below.

In certain embodiments, a double-strand break can be accompanied by two additional single-strand breaks, positioned by a second gRNA molecule and a third gRNA molecule.

In certain embodiments, first and second single-strand breaks can be accompanied by two additional single-strand breaks positioned by a third gRNA molecule and a fourth gRNA molecule.

When two or more gRNAs are used to position two or more cleavage events, e.g., double-strand or single-strand breaks, in a target nucleic acid, it is contemplated that the two or more cleavage events may be made by the same or different RNA-guided nucleases (e.g., Cas9 proteins). For example, when two gRNAs are used to position two double-strand breaks, a single Cas9 nuclease may be used to create both double-strand breaks. When two or more gRNAs are used to position two or more single-strand breaks (nicks), a single Cas9 nickase may be used to create the two or more nicks. When two or more gRNAs are used to position at least one double-strand break and at least one single-strand break, two Cas9 proteins may be used, e.g., one Cas9 nuclease and one Cas9 nickase. It is contemplated that when two or more Cas9 proteins are used that the two or more Cas9 proteins may be delivered sequentially to control specificity of a double-strand versus a single-strand break at the desired position in the target nucleic acid.

In some embodiments, the targeting domain of the first gRNA molecule and the targeting domain of the second gRNA molecules are complementary to opposite strands of the target nucleic acid molecule. In some embodiments, the gRNA molecule and the second gRNA molecule are configured such that the PAMs are oriented outward.

In certain embodiments, two gRNA are selected to direct Cas9-mediated cleavage at two positions that are a preselected distance from each other. In certain embodiments, the two points of cleavage are on opposite strands of the target nucleic acid. In some embodiments, the two cleavage points form a blunt ended break, and in other embodiments, they are offset so that the DNA ends comprise one or two overhangs (e.g., one or more 5' overhangs and/or one or more 3' overhangs). In some embodiments, each cleavage event is a nick. In certain embodiments, the nicks are close enough together that they form a break that is recognized by the double stranded break machinery (as opposed to being recognized by, e.g., the SSBr machinery). In certain embodiments, the nicks are far enough apart that they create an overhang that is a substrate for HDR, i.e., the placement of the breaks mimics a DNA substrate that has experienced some resection. For instance, in some embodiments the nicks are spaced to create an overhang that is a substrate for processive resection. In some embodiments, the two breaks are spaced within 25-65 nucleotides of each other. The two breaks may be, e.g., about 25, 30, 35, 40, 45, 50, 55, 60, or 65 nucleotides of each other. The two breaks may be, e.g., at least about 25, 30, 35, 40, 45, 50, 55, 60 or 65 nucleotides of each other. The two breaks may be, e.g., at most about 30, 35, 40, 45, 50, 55, 60, or 65 nucleotides of each other. In certain embodiments, the two breaks are about 25-30, 30-35, 35-40, 40-45, 45-50, 50-55, 55-60, or 60-65 nucleotides of each other.

In some embodiments, the break that mimics a resected break comprises a 3' overhang (e.g., generated by a DSB and a nick, where the nick leaves a 3' overhang), a 5' overhang (e.g., generated by a DSB and a nick, where the nick leaves a 5' overhang), a 3' and a 5' overhang (e.g., generated by three cuts), two 3' overhangs (e.g., generated by two nicks that are offset from each other), or two 5' overhangs (e.g., generated by two nicks that are offset from each other).

In certain embodiments in which two gRNAs (independently, unimolecular (or chimeric) or modular gRNA) complexing with Cas9 nickases induce two single-strand breaks for the purpose of inducing HDR-mediated correction, the closer nick is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, or 75 to 100 bp) away from the A1AT target position and the two nicks will ideally be within 25-65 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, 20, 10, or 5 bp away from each other). In certain embodiments, the cleavage site is between 0-100 bp (e.g., 0 to 75, 0 to 50, 0 to 25, 25 to 100, 25 to 75, 25 to 50, 50 to 100, 50 to 75, or 75 to 100 bp) away from the A1AT target position.

In some embodiments, two gRNAs, e.g., independently, unimolecular (or chimeric) or modular gRNA, are configured to position a double-strand break on both sides of a target position. In other embodiments, three gRNAs, e.g., independently, unimolecular (or chimeric) or modular gRNA, are configured to position a double-strand break (i.e., one gRNA complexes with a cas9 nuclease) and two single-strand breaks or paired single-strand breaks (i.e., two gRNAs complex with Cas9 nickases) on either side of the target position. In other embodiments, four gRNAs, e.g., independently, unimolecular (or chimeric) or modular gRNA, are configured to generate two pairs of single-strand breaks (i.e., two pairs of two gRNAs complex with Cas9 nickases) on either side of the target position. The double-strand break(s) or the closer of the two single-strand nicks in a pair will ideally be within 0-500 bp of the A1AT target position (e.g., no more than 450, 400, 350, 300, 250, 200, 150, 100, 50 or 25 bp from the target position). When nickases are used, the two nicks in a pair are, in certain embodiments, within 25-65 bp of each other (e.g., between 25 to 55, 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, or 20 or 10 bp).

When two gRNAs are used to target RNA-guided nucleases (e.g., Cas9 molecules) to breaks, different combinations of RNA-guided nucleases (e.g., Cas9 molecules) are envisioned. In some embodiments, a first gRNA is used to target a first RNA-guided nuclease (e.g., Cas9 molecule) to a first target position, and a second gRNA is used to target a second RNA-guided nuclease (e.g., Cas9 molecule) to a second target position. In some embodiments, the first RNA-guided nuclease (e.g., Cas9 molecule) creates a nick on the first strand of the target nucleic acid, and the second RNA-guided nuclease (e.g., Cas9 molecule) creates a nick on the opposite strand, resulting in a double-strand break (e.g., a blunt ended cut or a cut with overhangs).

Different combinations of nickases can be chosen to target one single-strand break to one strand and a second single-strand break to the opposite strand. When choosing a combination, one can take into account that there are nickases having one active RuvC-like domain, and nickases having one active HNH domain. In certain embodiments, a RuvC-like domain cleaves the non-complementary strand of the target nucleic acid molecule. In certain embodiments, an HNH-like domain cleaves a single stranded complementary domain, e.g., a complementary strand of a double stranded nucleic acid molecule. Generally, if both Cas9 molecules have the same active domain (e.g., both have an active RuvC domain or both have an active HNH domain), one will choose two gRNAs that bind to opposite strands of the target. In more detail, in some embodiments a first gRNA is complementary with a first strand of the target nucleic acid and binds a nickase having an active RuvC-like domain and causes that nickase to cleave the strand that is non-complementary to that first gRNA, i.e., a second strand of the target nucleic acid; and a second gRNA is complementary with a second strand of the target nucleic acid and binds a nickase having an active RuvC-like domain and causes that nickase to cleave the strand that is non-complementary to that second gRNA, i.e., the first strand of the target nucleic acid. Conversely, in some embodiments, a first gRNA is complementary with a first strand of the target nucleic acid and binds a nickase having an active HNH domain and causes that nickase to cleave the strand that is complementary to that first gRNA, i.e., a first strand of the target nucleic acid; and a second gRNA is complementary with a second strand of the target nucleic acid and binds a nickase having an active HNH domain and causes that nickase to cleave the strand that is complementary to that second gRNA, i.e., the second strand of the target nucleic acid. In another arrangement, if one Cas9 molecule has an active RuvC-like domain and the other Cas9 molecule has an active HNH domain, the gRNAs for both Cas9 molecules can be complementary to the same strand of the target nucleic acid, so that the Cas9 molecule with the active RuvC-like domain will cleave the non-complementary strand and the Cas9 molecule with the HNH domain will cleave the complementary strand, resulting in a double stranded break.

Homology Arms of the Donor Template

A homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., Alu repeats or LINE repeats.

Exemplary homology arm lengths include at least 50, 100, 250, 500, 750, 1000, 2000, 3000, 4000, or 5000 nucleotides. In some embodiments, the homology arm length is 50-100, 100-250, 250-500, 500-750, 750-1000, 1000-2000, 2000-3000, 3000-4000, or 4000-5000 nucleotides.

A template nucleic acid, as that term is used herein, refers to a nucleic acid sequence which can be used in conjunction with an RNA-guided nuclease (e.g., a Cas9 molecule) and a gRNA molecule to alter the structure of an A1AT target position. In certain embodiments, the A1AT target position can be a site between two nucleotides, e.g., adjacent nucleotides, on the target nucleic acid into which one or more nucleotides is added. Alternatively, the A1AT target position may comprise one or more nucleotides that are altered, e.g., corrected, by a template nucleic acid.

In certain embodiments, the target nucleic acid is modified to have some or all of the sequence of the template nucleic acid, typically at or near cleavage site(s). In certain embodiments, the template nucleic acid is single stranded. In other embodiments, the template nucleic acid is double stranded. In certain embodiments, the template nucleic acid is DNA, e.g., double stranded DNA. In other embodiments, the template nucleic acid is single stranded DNA. In an embodiment, the template nucleic acid is encoded on the same vector backbone, e.g., AAV genome, plasmid DNA, as the RNA-guided nuclease (e.g., Cas9 molecule) and gRNA. In certain embodiments, the template nucleic acid is excised from a vector backbone in vivo, e.g., it is flanked by gRNA recognition sequences. In certain embodiments, the template nucleic acid comprises endogenous genomic sequence.

In certain embodiments, the template nucleic acid alters the structure of the target position by participating in an HDR event. In certain embodiments, the template nucleic acid alters the sequence of the target position. In certain embodiments, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both a first site on the target sequence that is cleaved in a first Cas9 mediated event, and a second site on the target sequence that is cleaved in a second Cas9 mediated event.

In certain embodiments, the template nucleic acid can include sequence which results in an alteration in the coding sequence of a translated sequence, e.g., one which results in the substitution of one amino acid for another in a protein product, e.g., transforming a mutant allele into a wild-type allele, transforming a wild-type allele into a mutant allele, and/or introducing a stop codon, insertion of an amino acid residue, deletion of an amino acid residue, or a nonsense mutation.

In other embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in the SERPINA1 gene can be used to alter the structure of a target sequence. The template sequence can be used to alter an unwanted structure, e.g., an unwanted or mutant nucleotide.

A template nucleic acid typically comprises the following components:

[5' homology arm]-[replacement sequence]-[3' homology arm].

The homology arms provide for recombination into the chromosome, thus replacing the undesired element, e.g., a mutation or signature, with the replacement sequence. In certain embodiments, the homology arms flank the most distal cleavage sites.

In certain embodiments, the 3' end of the 5' homology arm is the position next to the 5' end of the replacement sequence. In certain embodiments, the 5' homology arm can extend at least 10, 20, 30, 40, 50, 100, 200, 300, 400, 500, 600, 700, 800, 900, 1000, 1500, 2000, 3000, 4000, or 5000 nucleotides 5' from the 5' end of the replacement sequence.

In certain embodiments, the 5' end of the 3' homology arm is the position next to the 3' end of the replacement sequence. In certain embodiments, the 3' homology arm can extend at least 10, 20, 30, 40, 50, 100, 200, 300, 400, 500, 600, 700, 800, 900, 1000, 1500, 2000, 3000, 4000, or 5000 nucleotides 3' from the 3' end of the replacement sequence.

In certain embodiments, to correct a mutation, the homology arms, e.g., the 5' and 3' homology arms, may each comprise about 1000 bp of sequence flanking the most distal gRNAs (e.g., 1000 bp of sequence on either side of the mutation).

It is contemplated herein that one or both homology arms may be shortened to avoid including certain sequence repeat elements, e.g., Alu repeats or LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that template nucleic acids for correcting a mutation may be designed for use as a single-stranded oligonucleotide, e.g., a single-stranded oligodeoxynucleotide (ssODN). When using a ssODN, 5' and 3' homology arms may range up to about 200 nucleotides in length, e.g., at least 25, 50, 75, 100, 125, 150, 175, or 200 nucleotides in length. Longer homology arms that may be 200 to 2000 nucleotides in length are also contemplated for ssODNs as improvements in oligonucleotide synthesis continue to be made. In some embodiments, a longer homology arm is made by a method other than chemical synthesis, e.g., by denaturing a long double stranded nucleic acid and purifying one of the strands, e.g., by affinity for a strand-specific sequence anchored to a solid substrate.

While not wishing to be bound by theory, in certain embodiments alt-HDR proceeds more efficiently when the template nucleic acid has extended homology 5' to the break (e.g., nick) (i.e., in the 5' direction of the nicked strand). Accordingly, in some embodiments, the template nucleic acid has a longer homology arm and a shorter homology arm, wherein the longer homology arm can anneal 5' of the break (e.g., nick). In some embodiments, the arm that can anneal 5' to the break (e.g., nick) is at least 25, 50, 75, 100, 125, 150, 175, or 200, 300, 400, 500, 600, 700, 800, 900, 1000, 1500, 2000, 3000, 4000, or 5000 nucleotides from the break (e.g., nick) or the 5' or 3' end of the replacement sequence. In some embodiments, the arm that can anneal 5' to the break (e.g., nick) is at least 10%, 20%, 30%, 40%, or 50% longer than the arm that can anneal 3' to the break (e.g., nick). In some embodiments, the arm that can anneal 5' to the break (e.g., nick) is at least 2×, 3×, 4×, or 5× longer than the arm that can anneal 3' to the break (e.g., nick). Depending on whether a ssDNA template can anneal to the intact strand or the nicked strand, the homology arm that anneals 5' to the break (e.g., nick) may be at the 5' end of the ssDNA template or the 3' end of the ssDNA template, respectively.

Similarly, in some embodiments, the template nucleic acid has a 5' homology arm, a replacement sequence, and a 3' homology arm, such that the template nucleic acid has extended homology to the 5' of the break (e.g., nick). For example, the 5' homology arm and 3' homology arm may be substantially the same length, but the replacement sequence may extend farther 5' of the break (e.g., nick) than 3' of the break (e.g., nick). In some embodiments, the replacement sequence extends at least 10%, 20%, 30%, 40%, 50%, 2×, 3×, 4×, or 5× further to the 5' end of the break (e.g., nick) than the 3' end of the break (e.g., nick).

While not wishing to be bound by theory, in some embodiments alt-HDR proceeds more efficiently when the template nucleic acid is centered on the break (e.g., nick). Accordingly, in some embodiments, the template nucleic acid has two homology arms that are essentially the same size. For instance, the first homology arm of a template nucleic acid may have a length that is within 10%, 9%, 8%, 7%, 6%, 5%, 4%, 3%, 2%, or 1% of the second homology arm of the template nucleic acid.

Similarly, in some embodiments, the template nucleic acid has a 5' homology arm, a replacement sequence, and a 3' homology arm, such that the template nucleic acid extends substantially the same distance on either side of the break (e.g., nick or double-strand break).

For example, the homology arms may have different lengths, but the replacement sequence may be selected to compensate for this. For example, the replacement sequence may extend further 5' from the break (e.g., nick or double-strand break) than it does 3' of the break (e.g., nick or double-strand break), but the homology arm 5' of the break (e.g., nick or double-strand break) is shorter than the homology arm 3' of the break (e.g., nick or double-strand break), to compensate. The converse is also possible, e.g., that the replacement sequence may extend further 3' from the break (e.g., nick or double-strand break) than it does 5' of the break (e.g., nick or double-strand break), but the homology arm 3' of the break (e.g., nick or double-strand break) is shorter than the homology arm 5' of the break (e.g., nick or double-strand break), to compensate.

Exemplary Template Nucleic Acids

In certain embodiments, the template nucleic acid is double stranded. In other embodiments, the template nucleic acid is single stranded. In certain embodiments, the template nucleic acid comprises a single stranded portion and a double stranded portion. In certain embodiments, the template nucleic acid comprises about 50 to 100 bp, e.g., 55 to 95, 60 to 90, 65 to 85, or 70 to 80 bp, homology on either side of the break (e.g., nick or double-strand break) and/or replacement sequence. In certain embodiments, the template nucleic acid comprises about 50, 55, 60, 65, 70, 75, 80, 85, 90, 95, or 100 bp homology 5' of the break (e.g., nick or double-strand break) or replacement sequence, 3' of the break (e.g., nick or double-strand break) or replacement sequence, or both 5' and 3' of the break (e.g., nick or double-strand break) or replacement sequences.

In certain embodiments, the template nucleic acid comprises about 150 to 200 bp, e.g., 155 to 195, 160 to 190, 165 to 185, or 170 to 180 bp, homology 3' of the break (e.g., nick or double-strand break) and/or replacement sequence. In certain embodiments, the template nucleic acid comprises about 150, 155, 160, 165, 170, 175, 180, 185, 190, 195, or 200 bp homology 3' of the break (e.g., nick or double-strand break) or replacement sequence. In certain embodiments, the template nucleic acid comprises less than about 100, 90, 80, 70, 60, 50, 40, 30, 20, 15, or 10 bp homology 5' of the break (e.g., nick or double-strand break) or replacement sequence.

In certain embodiments, the template nucleic acid comprises about 150 to 200 bp, e.g., 155 to 195, 160 to 190, 165 to 185, or 170 to 180 bp, homology 5' of the break (e.g., nick or double-strand break) and/or replacement sequence. In certain embodiments, the template nucleic acid comprises about 150, 155, 160, 165, 170, 175, 180, 185, 190, 195, or 200 bp homology 5' of the break (e.g., nick or double-strand break) or replacement sequence. In certain embodiments, the template nucleic acid comprises less than about 100, 90, 80, 70, 60, 50, 40, 30, 20, 15, or 10 bp homology 3' of the break (e.g., nick or double-strand break) or replacement sequence.

In certain embodiments, the template nucleic acid comprises a nucleotide sequence, e.g., of one or more nucleotides, that will be added to or will template a change in the target nucleic acid. In other embodiments, the template nucleic acid comprises a nucleotide sequence that may be used to modify the target position. In other embodiments, the template nucleic acid comprises a nucleotide sequence, e.g., of one or more nucleotides, that corresponds to wild-type sequence of the target nucleic acid, e.g., of the target position.

The template nucleic acid may comprise a replacement sequence. In some embodiments, the template nucleic acid comprises a 5' homology arm. In other embodiments, the template nucleic acid comprises a 3' homology arm.

In certain embodiments, the template nucleic acid is linear double stranded DNA. The length may be, e.g., about 150-200 bp, e.g., about 150, 160, 170, 180, 190, or 200 bp. The length may be, e.g., at least 150, 160, 170, 180, 190, or 200 bp. In some embodiments, the length is no greater than 150, 160, 170, 180, 190, or 200 bp. In some embodiments, a double stranded template nucleic acid has a length of about 160 bp, e.g., about 155-165, 150-170, 140-180, 130-190, 120-200, 110-210, 100-220, 90-230, or 80-240 bp.

The template nucleic acid can be linear single stranded DNA. In certain embodiments, the template nucleic acid is (i) linear single stranded DNA that can anneal to the nicked strand of the target nucleic acid, (ii) linear single stranded DNA that can anneal to the intact strand of the target nucleic acid, (iii) linear single stranded DNA that can anneal to the transcribed strand of the target nucleic acid, (iv) linear single stranded DNA that can anneal to the non-transcribed strand of the target nucleic acid, or more than one of the preceding. The length may be, e.g., about 150-200 nucleotides, e.g., about 150, 160, 170, 180, 190, or 200 nucleotides. The length may be, e.g., at least 150, 160, 170, 180, 190, or 200 nucleotides. In some embodiments, the length is no greater than 150, 160, 170, 180, 190, or 200 nucleotides. In some embodiments, a single stranded template nucleic acid has a length of about 160 nucleotides, e.g., about 155-165, 150-170, 140-180, 130-190, 120-200, 110-210, 100-220, 90-230, or 80-240 nucleotides. In certain embodiments, a single stranded template nucleic acid has a length of about 50-2000 nucleotides, e.g., about 50, 100, 200, 300, 400, 500, 600, 700, 800, 900, 1000, 1100, 1200, 1300, 1400, 1500, 1600, 1700, 1800, 1900, or 2000 nucleotides.

In some embodiments, the template nucleic acid is circular double stranded DNA, e.g., a plasmid. In some embodiments, the template nucleic acid comprises about 500 to 1000 bp of homology on either side of the replacement sequence and/or the break (e.g., nick or double-strand break). In some embodiments, the template nucleic acid comprises about 300, 400, 500, 600, 700, 800, 900, 1000, 1500, or 2000 bp of homology 5' of the break (e.g., nick or double-strand break) or replacement sequence, 3' of the break (e.g., nick or double-strand break) or replacement sequence, or both 5' and 3' of the break (e.g., nick or double-strand break) or replacement sequence. In some embodiments, the template nucleic acid comprises at least 300, 400, 500, 600, 700, 800, 900, 1000, 1500, or 2000 bp of homology 5' of the break (e.g., nick or double-strand break) or replacement sequence, 3' of the break (e.g., nick or double-strand break) or replacement sequence, or both 5' and 3' of the break (e.g., nick or double-strand break) or replacement sequence. In some embodiments, the template nucleic acid comprises no more than 300, 400, 500, 600, 700, 800, 900, 1000, 1500, or 2000 bp of homology 5' of the break (e.g., nick or double-strand break) or replacement sequence, 3' of the break (e.g., nick or double-strand break) or replacement sequence, or both 5' and 3' of the break (e.g., nick or double-strand break) or replacement sequence.

In certain embodiments, one or both homology arms may be shortened to avoid including certain sequence repeat elements, e.g., Alu repeats, LINE elements. For example, a 5' homology arm may be shortened to avoid a sequence repeat element, while a 3' homology arm may be shortened to avoid a sequence repeat element. In some embodiments, both the 5' and the 3' homology arms may be shortened to avoid including certain sequence repeat elements.

In some embodiments, the template nucleic acid is an adenovirus vector, e.g., an AAV vector, e.g., a ssDNA molecule of a length and sequence that allows it to be packaged in an AAV capsid. The vector may be, e.g., less than 5 kb and may contain an ITR sequence that promotes packaging into the capsid. The vector may be integration-deficient. In some embodiments, the template nucleic acid comprises about 150 to 1000 nucleotides of homology on either side of the replacement sequence and/or the break (e.g., nick or double-strand break). In some embodiments, the template nucleic acid comprises about 100, 150, 200, 300, 400, 500, 600, 700, 800, 900, 1000, 1500, or 2000 nucleotides 5' of the break (e.g., nick or double-strand break) or replacement sequence, 3' of the break (e.g., nick or double-strand break) or replacement sequence, or both 5' and 3' of the break (e.g., nick or double-strand break) or replacement sequence. In some embodiments, the template nucleic acid comprises at least 100, 150, 200, 300, 400, 500, 600, 700, 800, 900, 1000, 1500, or 2000 nucleotides 5' of the break (e.g., nick or double-strand break) or replacement sequence, 3' of the break (e.g., nick or double-strand break) or replacement sequence, or both 5' and 3' of the break (e.g., nick or double-strand break) or replacement sequence. In some embodiments, the template nucleic acid comprises at most 100, 150, 200, 300, 400, 500, 600, 700, 800, 900, 1000, 1500, or 2000 nucleotides 5' of the break (e.g., nick or double-strand break) or replacement sequence, 3' of the break (e.g., nick or double-strand break) or replacement sequence, or both 5' and 3' of the break (e.g., nick or double-strand break) or replacement sequence.

In some embodiments, the template nucleic acid is a lentiviral vector, e.g., an IDLV (integration deficiency lentivirus). In some embodiments, the template nucleic acid comprises about 500 to 1000 bp of homology on either side of the replacement sequence and/or the break (e.g., nick or double-strand break). In some embodiments, the template nucleic acid comprises about 300, 400, 500, 600, 700, 800, 900, 1000, 1500, or 2000 bp of homology 5' of the break (e.g., nick or double-strand break) or replacement sequence, 3' of the break (e.g., nick or double-strand break) or replacement sequence, or both 5' and 3' of the break (e.g., nick or double-strand break) or replacement sequence. In some embodiments, the template nucleic acid comprises at least 300, 400, 500, 600, 700, 800, 900, 1000, 1500, or 2000 bp of homology 5' of the break (e.g., nick or double-strand break) or replacement sequence, 3' of the break (e.g., nick or double-strand break) or replacement sequence, or both 5' and 3' of the break (e.g., nick or double-strand break) or replacement sequence. In some embodiments, the template nucleic acid comprises no more than 300, 400, 500, 600, 700, 800, 900, 1000, 1500, or 2000 bp of homology 5' of the break (e.g., nick or double-strand break) or replacement sequence, 3' of the break (e.g., nick or double-strand break) or replacement sequence, or both 5' and 3' of the break (e.g., nick or double-strand break) or replacement sequence.

In certain embodiments, the template nucleic acid comprises one or more mutations, e.g., silent mutations, that prevent Cas9 from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In certain embodiments, the template nucleic acid comprises at most 2, 3, 4, 5, 10, 20, 30, or 50 silent mutations relative to the corresponding sequence in the genome of the cell to be altered. In an embodiment, the cDNA comprises one or more mutations, e.g., silent mutations that prevent Cas9 from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In certain embodiments, the template nucleic acid comprises at most 2, 3, 4, 5, 10, 20, 30, or 50 silent mutations relative to the corresponding sequence in the genome of the cell to be altered.

In certain embodiments, a template nucleic acid for correcting a c.1024G>A mutation in the human SERPINA1 gene comprises, from the 5' to 3' direction, a 5' homology arm, a replacement sequence, and a 3' homology arm. In certain of these embodiments, the replacement sequence for correcting c.1024G>A comprises or consists of guanine-adenine-guanine (GAG) or guanine-adenine-adenine (GAA). In certain embodiments, the 5' and 3' homology arms each comprise a length of sequence flanking the Z mutation. For example, the 5' homology arm may comprise all or a portion of the sequence from 1 to 2000 bp upstream of the Z mutation (i.e., nucleotides 11990 to 13989 of SEQ ID NO:2231), while the 3' homology arm may comprise all or a portion of the sequence from 1 to 2000 bp downstream of the Z mutation (i.e., nucleotides 13991 to 15991 of SEQ ID NO:2231). In other embodiments, 5' and 3' homology arms for correcting c.1024G>A may each comprise a sequence flanking the most distal gRNAs. For example, the 5' and 3' homology arms may each comprise all or a portion of about 2000 bp of sequence flanking the most distal gRNAs. Shorter 5' and/or 3' homology arms may also be used. For example, it is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In certain embodiments, a template nucleic acid for correcting a c.1024G>A mutation (Z mutation) in the human SERPINA1 gene comprises a 5' homology arm and a 3' homology arm. In certain embodiments, the 5' and 3' homology arms each comprise a length of sequence flanking the c.1024G>A mutation. In certain of these embodiments, the 5' homology arm and 3' homology arm comprises or consists of guanine-adenine-guanine (GAG) or guanine-adenine-adenine (GAA) for correcting the c.1024G>A mutation. In certain embodiments, the template nucleic acid may comprise a single-stranded oligodeoxynucleotide (ssODN). In certain embodiments, the template nucleic acid has homology to the transcription strand of the target sequence. In certain embodiments, the template nucleic acid comprises, consists of, or consists essentially of a sequence from a transcription strand of the target sequence (e.g., minus strand of Chromosome 14, transcription strand of the SERPINA1 locus). In certain embodiments, the template nucleic acid comprises, e.g., at least 1, 2, 3, 4, 5, 10, 20, or 30 single nucleotide polymorphisms (SNPs). In certain embodiments, the template nucleic acid comprises a 5' homology arm that extends 5' from the break (e.g., nick or double-strand break) in the target nucleic acid and a 3' homology arm that extends 3' from the break (e.g., nick or double-strand break). In certain embodiments, the 5' homology arm may be longer in length than the 3' homology arm. In certain embodiments, the 5' homology arm to 3' homology arm asymmetry relative to the break (e.g., nick or double-strand break) is 75%:25% (length of 5' homology arm: length of 3' homology arm), 74%:26%, 73%:27%, 72%:28%, 71%:29%, 70%:30%, 69%:31%, 68%:32%, 67%:33%, 66%:34%, 65%:35%, 64%:36%, 63%:37%, 62%:38%, 61%:39%, 60%:40%, 59%:4%, 58%:42%, 57%:43%, 56%:44%, 55%:45%, 54%:46%, 53%:47%, 52%:48%, 51%:49%, 50%:50%, 49%:51%, 48%:52%, 47%:53%, 46%:54%, 45%:55%, 44%:56%, 43%:57%, 42%:58%, 41%:59%, or 40%:60%. In certain embodiments, the template nucleic acid comprises, consists essentially of, or consists of a 5' homology arm that extends about 125, about 120, about 115, about 110, about 105, about 100, about 95, about 90, about 85, about 80 nucleotides, 5' from the break (e.g., nick or double-strand break). In certain embodiments, the template nucleic acid comprises, consists essentially of, or consists of a 3' nucleotide sequence that extends about 40, about 45, about 50, about 55, about 60, about 65, about 70, about 75, about 80, about 85 nucleotides 3' from the break (e.g., nick or double-strand break). In certain embodiments, the template nucleic acid comprises, consists essentially of, or consists of a 5' nucleotide sequence that extends about 85-95 nucleotides 5' from the break (e.g., nick or double-strand break). In certain embodiments, the template nucleic acid comprises, consists essentially of, or consists of a 3' nucleotide sequence that extends about 60-70 nucleotides 3' from the break (e.g., nick or double-strand break). In certain embodiments, the 5' homology arm comprises, consists essentially of, or consists of SEQ ID NO:2208 (i.e., ssODN_1/ssODN_1_Z mutation 5' homology arm). In certain embodiments, the 3' homology arm comprises, consists essentially of, or consists of SEQ ID NO:2209 (i.e., ssODN_1/ssODN_1_Z mutation 3' homology arm). In certain embodiments, the template nucleic acid comprises, consists essentially of, or consists of SEQ ID NO:2228 (i.e., ssODN_1_Z mutation). In certain embodiments, the template nucleic acid comprises, consists essentially of, or consists of a 5' homology arm that extends about 95-105 nucleotides 5' from the break (e.g., nick or double-strand break). In certain embodiments, the template nucleic acid comprises, consists essentially of, or consists of a 3' homology arm that extends about 60-70 nucleotides 3' from the break (e.g., nick or double-strand break). In certain embodiments, the 5' homology arm comprises, consists essentially of, or consists of SEQ ID NO:2211 (i.e., ssODN_2/ssODN_2_Z mutation 5' homology arm). In certain embodiments, the 3' homology arm comprises, consists essentially of, or consists of SEQ ID NO:2212 (i.e., ssODN_2/ssODN_2_Z mutation 3' homology arm). In certain embodiments, the template nucleic acid sequence comprises, consists essentially of, or consists of SEQ ID NO:2229 (i.e., ssODN_2_Z mutation).

As indicated in Table 13, the ssODNs of SEQ ID NO:2228 (i.e., ssODN_1_Z mutation) and SEQ ID NO:2229 (i.e., ssODN_2_Z mutation) each contain single nucleotide polymorphisms (SNPs). As described in Example 6, there are four sets of SNPs present in the ssODNs resulting in ten mutations: (1) the first set introduces the Z-mutation (GAG>AAA as shown in the bold and shaded sequence in Table 13), (2) the second set introduces an MfeI restriction site on the target sequence to quantify HDR efficiency using a restriction fragment length polymorphism (RFLP) assay, which also disrupts the recognition of the PAM sequence of sgRNA1889 and the genomic DNA post HDR events (underscored and lowercase letters in Table 13), (3) the third set disrupts the recognition of the PAM sequence of sgRNA1889 and the genomic DNA post HDR events (bold and italicized nucleotides in Table 13), and (4) the fourth set prevents gRNA re-recognition and Cas9 re-cutting post HDR events (underscored nucleotides in Table 13). In certain embodiments, the template nucleic acid may comprise SEQ ID NO:2228 (i.e., ssODN_1_Z mutation) or SEQ ID NO:2229 (i.e., ssODN_2_Z mutation), lacking one or more SNPs presented in Table 13. For example, the template nucleic acid may comprise SEQ ID NO:2228 (i.e., ssODN_1_Z mutation) or SEQ ID NO:2229 (i.e., ssODN_2_Z mutation), wherein one or more SNPs is removed from the template nucleic acid and mutated back to the corresponding nucleotide of the transcription strand of the SERPINA1 locus.

Suitable promoter sequences can be a constitutive promoter, a tissue-specific promoter, and/or a synthetic promoter with or without enhancer sequence(s).

In certain embodiments, a template nucleic acid comprises a replacement sequence flanked by a 5' homology arm and a 3' homology arm each independently comprising 10 or more, 20 or more, 50 or more, 100 or more, 150 or more, 200 or more, 250 or more, 300 or more, 350 or more, 400 or more, 450 or more, 500 or more, 550 or more, 600 or more, 650 or more, 700 or more, 750 or more, 800 or more, 850 or more, 900 or more, 1000 or more, 1100 or more, 1200 or more, 1300 or more, 1400 or more, 1500 or more, 1600 or more, 1700 or more, 1800 or more, 1900 or more, or 2000 or more nucleotides. In certain embodiments, a template nucleic acid comprises a replacement sequence flanked by a 5' homology arm and a 3' homology arm each independently comprising at least 50, 100, or 150 nucleotides, but not long enough to include a repeated element. In certain embodiments, a template nucleic acid comprises a replacement sequence flanked by a 5' homology arm and a 3' homology arm each independently comprising 5 to 100, 10 to 150, or 20 to 150 nucleotides. In certain embodiments, a replacement sequence comprises G, A, or a cDNA sequence described herein, and optionally comprises a promoter and/or polyA signal.

NHEJ Approaches for Gene Targeting

In certain embodiments of the methods provided herein, one or both alleles of the SERPINA1 gene are knocked out using NHEJ. As described herein, nuclease-induced NHEJ can be used to target gene-specific knockouts and remove (e.g., delete) sequences in a gene of interest.

While not wishing to be bound by theory, it is believed that, in certain embodiments, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; they are most commonly in the 1-50 bp range, but can reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs (e.g., motifs less than or equal to 50 nucleotides in length) as long as the generation of a specific final sequence is not required. If a double-strand break is targeted near to a target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. In this way, DNA segments as large as several hundred kilobases can be deleted. Both of these approaches can be used to delete specific DNA sequences; however, the error-prone nature of NHEJ may still produce indel mutations at the site of repair.

Both double strand cleaving eaCas9 molecules and single strand, or nickase, eaCas9 molecules can be used in the methods and compositions described herein to generate NHEJ-mediated indels. NHEJ-mediated indels targeted to the gene, e.g., a coding region, e.g., an early coding region of a gene, of interest can be used to knockout (i.e., eliminate expression of) a gene of interest. For example, early coding region of a gene of interest includes sequence immediately following a start codon, within a first exon of the coding sequence, or within 500 bp of the start codon (e.g., less than 500, 450, 400, 350, 300, 250, 200, 150, 100, or 50 bp).

Placement of Double Strand or Single Strand Breaks Relative to the Target Position In certain embodiments in which a gRNA and RNA-guided nuclease (e.g., Cas9 nuclease) generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In an embodiment, the cleavage site is between 0-30 bp away from the target position (e.g., less than 30, 25, 20, 15, 10, 9, 8, 7, 6, 5, 4, 3, 2, or 1 bp from the target position).

In certain embodiments, in which two gRNAs complexing with Cas9 nickases induce two single strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In certain embodiments, the gRNAs are configured to position cuts at the same position, or within a few nucleotides of one another, on different strands, essentially mimicking a double strand break. In certain embodiments, the closer nick is between 0-30 bp away from the target position (e.g., less than 30, 25, 20, 15, 10, 9, 8, 7, 6, 5, 4, 3, 2, or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20, or 10 bp). In certain embodiments, the gRNAs are configured to place a single strand break on either side of a nucleotide of the target position.

Both double strand cleaving eaCas9 molecules and single strand, or nickase, eaCas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks in deleted). In certain embodiments, two gRNAs, e.g., independently, unimolecular (or chimeric) or modular gRNA, are configured to position a double-strand break on both sides of a target position. In other embodiments, three gRNAs, e.g., independently, unimolecular (or chimeric) or modular gRNA, are configured to position a double strand break (i.e., one gRNA complexes with a cas9 nuclease) and two single strand breaks or paired single strand breaks (i.e., two gRNAs complex with Cas9 nickases) on either side of the target position. In still other embodiments, four gRNAs, e.g., independently, unimolecular (or chimeric) or modular gRNA, are configured to generate two pairs of single strand breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50, or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20, or 10 bp).

Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized.

Other DNA Repair Pathways
SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott 2008, and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged.' End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonuclease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Polo, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways have a common feature in that they typically recognize a lesion on one strand of the DNA, then exo/endonucleases remove the lesion and leave a 1-30 nucleotide gap that is sub-sequentially filled in by DNA polymerase and finally sealed with ligase. A more complete picture is given in Li 2008, and a summary is provided here.

Mismatch repair (MMR) operates on mispaired DNA bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger IL mispairs.

hMLH1 heterodimerizes with hPMS2 to form hMutLα which possesses an ATPase activity and is important for multiple steps of MMR. It possesses a PCNA/replication factor C (RFC)-dependent endonuclease activity which plays an important role in 3' nick-directed MMR involving EXO1 (EXO1 is a participant in both HR and MMR.) It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott 2008, and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Polβ that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5' flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER.

Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn 2014, and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA polβ and Rev1.

Error-free postreplication repair (PRR) is another pathway for repairing a single stranded break left after a defective replication event.

Examples of gRNAs in Genome Editing Methods gRNA molecules as described herein can be used with Cas9 molecules that generate a double strand break or a single strand break to alter the sequence of a target nucleic acid, e.g., a target position or target genetic signature. gRNA molecules useful in these methods are described below.

In certain embodiments, the gRNA, e.g., a chimeric gRNA, is configured such that it comprises one or more of the following properties:

(a) it can position, e.g., when targeting a Cas9 molecule that makes double strand breaks, a double strand break (i) within 50, 100, 150, 200, 250, 300, 350, 400, 450, or 500 nucleotides of a target position, or (ii) sufficiently close that the target position is within the region of end resection;

(b) it has a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and (c)(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes*, *S. thermophilus* or *S. aureus* tail and proximal domain, or a sequence that differs by no more than 1, 2, 3, 4, 5, 6, 7, 8, 9, or 10 nucleotides therefrom;

(c)(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus*, or *S. aureus* gRNA, or a sequence that differs by no more than 1, 2, 3, 4, 5, 6, 7, 8, 9 or 10 nucleotides therefrom;

(c)(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus*, or *S. aureus* gRNA, or a sequence that differs by no more than 1, 2, 3, 4, 5, 6, 7, 8, 9 or 10 nucleotides therefrom;

(c)(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus*, or *S. aureus* tail domain, or a sequence that differs by no more than 1, 2, 3, 4, 5, 6, 7, 8, 9, or 10 nucleotides therefrom; or (c)(v) the tail domain comprises 15, 20, 25, 30, 35, 40 nucleotides or all of the corresponding portions of a naturally occurring tail domain, e.g., a naturally occurring *S. pyogenes, S. thermophilus*, or *S. aureus* tail domain.

In certain embodiments, the gRNA is configured such that it comprises properties a and b(i); a and b(ii); a and b(iii); a and b(iv); a and b(v); a and b(vi); a and b(vii); a and b(viii); a and b(ix); a and b(x); a and b(xi); a and c; a, b, and c; a(i), b(i), and c(i); a(i), b(i), and c(ii); a(i), b(ii), and c(i); a(i), b(ii), and c(ii); a(i), b(iii), and c(i); a(i), b(iii), and c(ii); a(i), b(iv), and c(i); a(i), b(iv), and c(ii); a(i), b(v), and c(i); a(i), b(v), and c(ii); a(i), b(vi), and c(i); a(i), b(vi), and c(ii); a(i), b(vii), and c(i); a(i), b(vii), and c(ii); a(i), b(viii), and c(i); a(i), b(viii), and c(ii); a(i), b(ix), and c(i); a(i), b(ix), and c(ii); a(i), b(x), and c(i); a(i), b(x), and c(ii); a(i), b(xi), or c(i); a(i), b(xi), and c(ii).

In certain embodiments, the gRNA, e.g., a chimeric gRNA, is configured such that it comprises one or more of the following properties:

(a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;

(b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and (c)(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus*, or *S. aureus* tail and proximal domain, or a sequence that differs by no more than 1, 2, 3, 4, 5, 6, 7, 8, 9 or 10 nucleotides therefrom;

(c)(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus*, or *S. aureus* gRNA, or a sequence that differs by no more than 1, 2, 3, 4, 5, 6, 7, 8, 9 or 10 nucleotides therefrom;

(c)(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus*, or *S. aureus* gRNA, or a sequence that differs by no more than 1, 2, 3, 4, 5, 6, 7, 8, 9, or 10 nucleotides therefrom;

(c)(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus*, or *S. aureus* tail domain, or a sequence that differs by no more than 1, 2, 3, 4, 5, 6, 7, 8, 9 or 10 nucleotides therefrom; or (c)(v) the tail domain comprises 15, 20, 25, 30, 35, or 40 nucleotides or all of the corresponding portions of a naturally occurring tail domain, e.g., a naturally occurring *S. pyogenes, S. thermophilus*, or *S. aureus* tail domain.

In certain embodiments, the gRNA is configured such that it comprises properties a and b(i); a and b(ii); a and b(iii); a and b(iv); a and b(v); a and b(vi); a and b(vii); a and b(viii); a and b(ix); a and b(x); a and b(xi); a and c; a, b, and c; a(i), b(i), and c(i); a(i), b(i), and c(ii); a(i), b(ii), and c(i); a(i), b(ii), and c(ii); a(i), b(iii), and c(i); a(i), b(iii), and c(ii); a(i), b(iv), and c(i); a(i), b(iv), and c(ii); a(i), b(v), and c(i); a(i), b(v), and c(ii); a(i), b(vi), and c(i); a(i), b(vi), and c(ii); a(i), b(vii), and c(i); a(i), b(vii), and c(ii); a(i), b(viii), and c(i); a(i), b(viii), and c(ii); a(i), b(ix), and c(i); a(i), b(ix), and c(ii); a(i), b(x), and c(i); a(i), b(x), and c(ii); a(i), b(xi), and c(i); a(i), b(xi), and c(ii).

In certain embodiments, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at 840, e.g., the H840A.

In an embodiment, the gRNAs are used with a Cas9 nickase molecule having RuvC activity, e.g., a Cas9 molecule having the HNH activity inactivated, e.g., a Cas9 molecule having a mutation at N863, e.g., the N863A mutation.

In an embodiment, a pair of gRNAs, e.g., a pair of chimeric gRNAs, comprising a first and a second gRNA, is configured such that they comprises one or more of the following properties:

(a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;

(b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides;

(c)(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus*, or *S. aureus* tail and proximal domain, or a sequence that differs by no more than 1, 2, 3, 4, 5, 6, 7, 8, 9, or 10 nucleotides therefrom;

(c)(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus*, or *S. aureus* gRNA, or a sequence that differs by no more than 1, 2, 3, 4, 5, 6, 7, 8, 9, or 10 nucleotides therefrom;

(c)(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus*, or *S. aureus* gRNA, or a sequence that differs by no more than 1, 2, 3, 4, 5, 6, 7, 8, 9 or 10 nucleotides therefrom;

(c)(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus*, or *S. aureus* tail domain; or, or a sequence that differs by no more than 1, 2, 3, 4, 5, 6, 7, 8, 9, or 10 nucleotides therefrom; or (c)(v) the tail domain comprises 15, 20, 25, 30, 35, or 40 nucleotides or all of the corresponding portions of a naturally occurring tail domain, e.g., a naturally occurring *S. pyogenes, S. thermophilus*, or *S. aureus* tail domain;

(d) the gRNAs are configured such that, when hybridized to target nucleic acid, they are separated by 0-50, 0-100, 0-200, at least 10, at least 20, at least 30 or at least 50 nucleotide;

(e) the breaks made by the first gRNA and second gRNA are on different strands; and (f) the PAMs are facing outwards.

In certain embodiments, one or both of the gRNAs is configured such that it comprises properties a and b(i); a and b(ii); a and b(iii); a and b(iv); a and b(v); a and b(vi); a and b(vii); a and b(viii); a and b(ix); a and b(x); a and b(xi); a and c; a, b, and c; a(i), b(i), and c(i); a(i), b(i), and c(ii); a(i), b(i), c, and d; a(i), b(i), c, and e; a(i), b(i), c, d, and e; a(i), b(ii), and c(i); a(i), b(ii), and c(ii); a(i), b(ii), c, and d; a(i), b(ii), c, and e; a(i), b(ii), c, d, and e; a(i), b(iii), and c(i); a(i), b(iii), and c(ii); a(i), b(iii), c, and d; a(i), b(iii), c, and e; a(i), b(iii), c, d, and e; a(i), b(iv), and c(i); a(i), b(iv), and c(ii); a(i), b(iv), c, and d; a(i), b(iv), c, and e; a(i), b(iv), c, d, and e; a(i), b(v), and c(i); a(i), b(v), and c(ii); a(i), b(v), c, and d; a(i), b(v), c, and e; a(i), b(v), c, d, and e; a(i), b(vi), and c(i); a(i), b(vi), and c(ii); a(i), b(vi), c, and d; a(i), b(vi), c, and e; a(i), b(vi), c, d, and e; a(i), b(vii), and c(i); a(i), b(vii), and c(ii); a(i), b(vii), c, and d; a(i), b(vii), c, and e; a(i), b(vii), c, d, and e; a(i), b(viii), and c(i); a(i), b(viii), and c(ii); a(i), b(viii), c, and d; a(i), b(viii), c, and e; a(i), b(viii), c, d, and e; a(i), b(ix), and c(i); a(i), b(ix), and c(ii); a(i), b(ix), c, and d; a(i), b(ix), c, and e; a(i), b(ix), c, d, and e; a(i), b(x), and c(i); a(i), b(x), and c(ii); a(i), b(x), c, and d; a(i), b(x), c, and e; a(i), b(x), c, d, and e; a(i), b(xi), and c(i); a(i), b(xi), and c(ii); a(i), b(xi), c, and d; a(i), b(xi), c, and e; a(i), b(xi), c, d, and e.

In certain embodiments, the gRNAs are used with a Cas9 nickase molecule having HNH activity, e.g., a Cas9 molecule having the RuvC activity inactivated, e.g., a Cas9 molecule having a mutation at D10, e.g., the D10A mutation.

In certain embodiments, the gRNAs are used with a Cas9 nickase molecule having RuvC activity, e.g., a Cas9 molecule having the HNH activity inactivated, e.g., a Cas9 molecule having a mutation at H840, e.g., the H840A mutation.

In certain embodiments, the gRNAs are used with a Cas9 nickase molecule having RuvC activity, e.g., a Cas9 molecule having the HNH activity inactivated, e.g., a Cas9 molecule having a mutation at N863, e.g., the N863A mutation.

Target Cells

RNA-guided nucleases (e.g., Cas9 molecules) and gRNA molecules, e.g., an RNA-guided nuclease (e.g., Cas9 molecule)/gRNA molecule complex, can be used to alter (e.g., introduce a mutation in) a target nucleic acid, e.g., the SERPINA1 target gene, in a wide variety of cells. In certain embodiments, alteration of a target nucleic acid in a target cell may be performed in vitro, ex vivo or in vivo.

The RNA-guided nuclease (e.g., Cas9 molecules) and gRNA molecules described herein can be delivered to a target cell. In certain embodiments, the target cell is a hepatocyte. In other embodiments, the target cell is a lung epithelial cell. In certain embodiments, the target cell is a circulating blood cell, e.g., a monocyte, a mononuclear phagocyte, a macrophage, an alveolar macrophage, a myeloid progenitor cell, or a hematopoietic stem cell. In certain embodiments, the target cell is a bone marrow cell, (e.g., a myeloid progenitor cell, a hematopoietic stem cell, or a mesenchymal stem cell). In an embodiment, the target cell is a myeloid progenitor cell (e.g., a common myeloid progenitor (CMP) cell). In certain embodiments, the target cell is a hematopoietic stem cell (e.g., a long term hematopoietic stem cell (LT-HSC), a short term hematopoietic stem cell (ST-HSC), a multipotent progenitor (MPP) cell, a lineage restricted progenitor (LRP) cell).

In certain embodiments, the methods provided herein comprise treating a cell ex vivo and returning the cell to a patient. In certain embodiments, an autologous or heterologous stem cell can be treated ex vivo and returned to the subject. In certain embodiments, an autologous hepatocyte, heterologous hepatocyte, lung epithelium cell, mononuclear phagocyte, alveolar macrophage, myeloid precursor cell, or any combination thereof is treated ex vivo and returned to (e.g., transplanted into) the subject.

In certain embodiments, the target cell is manipulated ex vivo by editing (e.g., introducing a mutation in) the SERPINA1 target gene and/or modulating the expression of the SERPINA1 target gene, and administered to the subject. Sources of target cells for ex vive manipulation may include, by way of example, the subject's blood, the subject's cord blood, or the subject's bone marrow. Sources of target cells for ex vivo manipulation may also include, by way of example; heterologous donor blood, cord blood, or bone marrow.

In certain embodiments, a hepatocyte is removed from the subject, manipulated ex vivo as described above, and returned to the subject. In certain embodiments, a myeloid progenitor cell is removed from the subject, manipulated ex vivo as described above, and returned to the subject. In certain embodiments, an alveolar macrophage is removed from the subject, manipulated ex vivo as described above, and returned to the subject. In certain embodiments, a macrophage is removed from the subject, manipulated ex vivo as described above, and returned to the subject. In certain embodiments, a lung epithelial cell is removed from the subject, manipulated ex vivo as described above, and returned to the subject. In certain embodiments, a hematopoietic stem cell is removed from the subject, manipulated ex vivo as described above, and returned to the subject.

A suitable cell can also include a stem cell such as, e.g., an embryonic stem cell, induced pluripotent stem cell, hematopoietic stem cell, neuronal stem cell, or mesenchymal stem cell. In certain embodiments, the cell is an induced pluripotent stem (iPS) cell or a cell derived from an iPS cell, e.g., an iPS cell generated from the subject, modified to correct the mutation, and differentiated into a clinically relevant cell such as, e.g., a hepatocyte, macrophage, mononuclear phagocyte, alveolar macrophage, myeloid progenitor cell, lung epithelial cell, or hematopoietic stem cell. In certain embodiments, AAV is used to transduce the target cells.

Cells produced by the methods described herein may be used immediately. Alternatively, the cells may be frozen (e.g., in liquid nitrogen) and stored for later use. The cells will usually be frozen in 10% dimethylsulfoxide (DMSO), 50% serum, 40% buffered medium, or some other such solution as is commonly used in the art to preserve cells at such freezing temperature, and thawed in such a manner as commonly known in the art for thawing frozen cultured cells.

Delivery, Formulations, and Routes of Administration

CRISPR/RNA-guided nuclease system components, e.g., a Cas9 molecule, a gRNA molecule (e.g., a Cas9 molecule/gRNA molecule complex), a donor template nucleic acid, or all three, can be delivered, formulated, or administered in a variety of forms, see, e.g., Tables 3 and 4. Table 3 provides examples of how the components can be formulated, delivered, or administered. Table 4 summarizes various delivery methods for the components of a CRISPR/RNA-guided nuclease system, e.g., a Cas9 molecule component and a gRNA molecule component, as described herein.

In certain embodiments, one Cas9 molecule and two or more (e.g., 2, 3, 4, or more) different gRNA molecules are delivered, e.g., by an AAV vector. In certain embodiments, the sequence encoding the Cas9 molecule and the sequence(s) encoding the two or more (e.g., 2, 3, 4, or more) different gRNA molecules are present on the same nucleic acid molecule, e.g., an AAV vector. When a Cas9 or gRNA component is delivered encoded in DNA the DNA will typically include a control region, e.g., comprising a promoter, to effect expression. Useful promoters for Cas9 molecule sequences include CMV, EFS, EF-1a. MSCV, PGK, CAG, ALB, and SERPINA1 promoters. In an embodiment, the promoter is a constitutive promoter. In another embodiment, the promoter is a tissue specific promoter. Useful promoters for gRNAs include H1, EF-1a U6, and tRNA promoters. Promoters with similar or dissimilar strengths can be selected to tune the expression of components. Sequences encoding a Cas9 molecule can comprise a nuclear localization signal (NLS), e.g., an SV40 NLS. In an embodiment, the sequence encoding a Cas9 molecule comprises at least two nuclear localization signals. In an embodiment, a promoter for a Cas9 molecule or a gRNA molecule can be, independently, inducible, tissue specific, or cell specific.

DNA-Based Delivery of an RNA-Guided Nuclease Molecule and One or More gRNA Molecules Nucleic acids encoding RNA-guided nuclease molecules (e.g., Cas9 molecules, e.g., eaCas9 molecules), gRNA molecules, a donor template nucleic acid, or any combination (e.g., two or all) thereof can be administered to subjects or delivered into cells by art-known methods or as described herein. For example, Cas9-encoding and/or gRNA-encoding DNA, as well as donor template nucleic acids can be delivered by, e.g., vectors (e.g., viral or non-viral vectors), non-vector based methods (e.g., using naked DNA or DNA complexes), or a combination thereof.

Nucleic acids encoding Cas9 molecules (e.g., eaCas9 molecules) and/or gRNA molecules can be conjugated to molecules (e.g., N-acetylgalactosamine) promoting uptake by the target cells (e.g., hepatocytes). Donor template molecules can likewise be conjugated to molecules (e.g., N-acetylgalactosamine) promoting uptake by the target cells (e.g., hepatocytes).

In some embodiments, the Cas9- and/or gRNA-encoding DNA is delivered by a vector (e.g., viral vector/virus or plasmid).

Vectors can comprise a sequence that encodes a Cas9 molecule and/or a gRNA molecule and/or a donor template with high homology to the region (e.g., target sequence) being targeted. In certain embodiments, the donor template comprises all or part of a target sequence. Exemplary donor templates are a repair template, e.g., a gene correction template, or a gene mutation template, e.g., point mutation (e.g., single nucleotide (nt) substitution) template). A vector can also comprise a sequence encoding a signal peptide (e.g., for nuclear localization, nucleolar localization, or mitochondrial localization), fused, e.g., to a Cas9 molecule sequence. For example, the vectors can comprise a nuclear localization sequence (e.g., from SV40) fused to the sequence encoding the Cas9 molecule.

One or more regulatory/control elements, e.g., promoters, enhancers, introns, polyadenylation signals, Kozak consensus sequences, or internal ribosome entry sites (IRES), can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In some embodiments, the promoter is a viral promoter. In other embodiments, the promoter is a non-viral promoter.

In some embodiments, the vector is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). In some embodiments, the virus infects dividing cells. In other embodiments, the virus infects non-dividing cells. Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In an embodiment, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the target cell surface (e.g., a ligand-receptor, monoclonal antibody, avidin-biotin and chemical conjugation).

In some embodiments, the RNA-guided nuclease (e.g., Cas9)- and/or gRNA-encoding nucleic acid sequence is delivered by a recombinant retrovirus. In some embodiments, the retrovirus (e.g., Moloney murine leukemia virus) comprises a reverse transcriptase, e.g., that allows integration into the host genome. In some embodiments, the retrovirus is replication-competent. In other embodiments, the retrovirus is replication-defective, e.g., having one of more coding regions for the genes necessary for additional rounds of virion replication and packaging replaced with other genes, or deleted.

In some embodiments, the RNA-guided nuclease (e.g., Cas9)- and/or gRNA-encoding nucleic acid sequence is delivered by a recombinant lentivirus. In an embodiment, the donor template nucleic acid is delivered by a recombinant retrovirus. For example, the lentivirus is replication-defective, e.g., does not comprise one or more genes required for viral replication.

In an embodiment, the RNA-guided nuclease (e.g., Cas9)- and/or gRNA-encoding nucleic acid sequence is delivered by a recombinant lentivirus. In an embodiment, the donor template nucleic acid is delivered by a recombinant lentivirus. For example, the lentivirus is replication-defective, e.g., does not comprise one or more genes required for viral replication.

In some embodiments, the RNA-guided nuclease (e.g., Cas9)- and/or gRNA-encoding nucleic acid sequence is delivered by a recombinant adenovirus. In an embodiment, the donor template nucleic acid is delivered by a recombinant adenovirus. In some embodiments, the adenovirus is engineered to have reduced immunity in human.

In some embodiments, the RNA-guided nuclease (e.g., Cas9)- and/or gRNA-encoding nucleic acid sequence is delivered by a recombinant AAV. In an embodiment, the donor template nucleic acid is delivered by a recombinant AAV. In some embodiments, the AAV does not incorporate its genome into that of a host cell, e.g., a target cell as describe herein. In some embodiments, the AAV can incorporate its genome into that of the host cell. In some embodiments, the AAV is a self-complementary adeno-associated virus (scAAV), e.g., a scAAV that packages both strands which anneal together to form double stranded DNA.

In an embodiment, an AAV capsid that can be used in the methods described herein is a capsid sequence from serotype AAV1, AAV2, AAV3, AAV4, AAV8, AAV6, AAV7, AAV8, AAV9, AAV.rh8, AAV.rh10, AAV.rh32/33, AAV.rh43, AAV.rh64R1, or AAV7m8.

In an embodiment, the RNA-guided nuclease (e.g., Cas9)- and/or gRNA-encoding DNA is delivered in a re-engineered AAV capsid, e.g., with 50% or greater, e.g., 60% or greater, 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV.rh64R1.

In an embodiment, the RNA-guided nuclease (e.g., Cas9)- and/or gRNA-encoding DNA is delivered by a chimeric AAV capsid. In an embodiment, the donor template nucleic acid is delivered by a chimeric AAV capsid. Exemplary chimeric AAV capsids include, but are not limited to, AAV9i1, AAV2i8, AAV-DJ, AAV2G9, AAV2i8G9, or AAV8G9.

In an embodiment, the AAV is a self-complementary adeno-associated virus (scAAV), e.g., a scAAV that packages both strands which anneal together to form double stranded DNA.

In some embodiments, the RNA-guided nuclease (e.g., Cas9)- and/or gRNA-encoding DNA is delivered by a hybrid virus, e.g., a hybrid of one or more of the viruses described herein. In an embodiment, the hybrid virus is hybrid of an AAV (e.g., of any AAV serotype), with a Bocavirus, B19 virus, porcine AAV, goose AAV, feline AAV, canine AAV, or MVM.

A packaging cell is used to form a virus particle that is capable of infecting a target cell. Exemplary packaging cells include 293 cells, which can package adenovirus, and ψ2 or PA317 cells, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, e.g., Cas9. For example, an AAV vector used in gene therapy typically only possesses inverted terminal repeat (ITR) sequences from the AAV genome which are required for packaging and gene expression in the host or target cell. The missing viral functions can be supplied in trans by the packaging cell line and/or plasmid containing E2A, E4, and VA genes from adenovirus, and plasmid encoding Rep and Cap genes from AAV, as described in "Triple Transfection Protocol." Henceforth, the viral DNA is packaged in a cell line, which contains a helper plasmid encoding the other AAV genes, namely rep and cap, but lacking ITR sequences. In certain embodiments, the viral DNA is packaged in a producer cell line, which contains E1A and/or E1B genes from adenovirus. The cell line is also infected with adenovirus as a helper. The helper virus (e.g., adenovirus or HSV) or helper plasmid promotes replication of the AAV vector and expression of AAV genes from the helper plasmid with ITRs. The helper plasmid is not packaged in significant amounts due to a lack of ITR sequences. Contamination with adenovirus can be reduced by, e.g., heat treatment to which adenovirus is more sensitive than AAV.

In an embodiment, the viral vector is capable of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibody, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas9 and gRNA) to only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutinin (HA) can be incorporated to increase viral uptake into cells. In an embodiment, the viral vector has the ability of nuclear localization. For example, a virus that requires the breakdown of the nuclear envelope (during cell division) and therefore will not infect a non-diving cell can be altered to incorporate a nuclear localization peptide in the matrix protein of the virus thereby enabling the transduction of non-proliferating cells.

In some embodiments, the RNA-guided nuclease (e.g., Cas9)- and/or gRNA-encoding DNA is delivered by a non-vector based method (e.g., using naked DNA or DNA complexes). For example, the DNA can be delivered, e.g., by organically modified silica or silicate (Ormosil), electroporation, transient cell compression or squeezing (see, e.g., Lee 2012), gene gun, sonoporation, magnetofection, lipid-mediated transfection, dendrimers, inorganic nanoparticles, calcium phosphates, or a combination thereof.

In an embodiment, delivery via electroporation comprises mixing the cells with the RNA-guided nuclease (e.g., Cas9)- and/or gRNA-encoding DNA in a cartridge, chamber or cuvette and applying one or more electrical impulses of defined duration and amplitude. In an embodiment, delivery via electroporation is performed using a system in which cells are mixed with the RNA-guided nuclease (e.g., Cas9)- and/or gRNA-encoding DNA in a vessel connected to a device (e.g., a pump) which feeds the mixture into a cartridge, chamber or cuvette wherein one or more electrical impulses of defined duration and amplitude are applied, after which the cells are delivered to a second vessel.

In some embodiments, the RNA-guided nuclease (e.g., Cas9)- and/or gRNA-encoding DNA is delivered by a combination of a vector and a non-vector based method. In an embodiment, the donor template nucleic acid is delivered by a combination of a vector and a non-vector based method. For example, virosomes combine liposomes with an inactivated virus (e.g., HIV or influenza virus), which can result in more efficient gene transfer, e.g., in respiratory epithelial cells than either viral or liposomal methods alone.

In certain embodiments, the delivery vehicle is a non-viral vector, and in certain of these embodiments the non-viral vector is an inorganic nanoparticle. Exemplary inorganic nanoparticles include, e.g., magnetic nanoparticles (e.g., $Fe_3MnO_2$) or silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 1. Exemplary polymers for gene transfer are shown below in Table 5.

In an embodiment, the vehicle has targeting modifications to increase target cell update of nanoparticles and liposomes, e.g., cell specific antigens, monoclonal antibodies, single chain antibodies, aptamers, polymers, sugars (e.g., N-acetylgalactosamine (GalNAc)), and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovesicle (30-100 nm) of endocytic origin (e.g., can be produced from various cell types and can therefore be taken up by cells without the need for targeting ligands).

In an embodiment, one or more nucleic acid molecules (e.g., DNA molecules) other than the components of a CRISPR/RNA-guided nuclease system, e.g., the Cas9 molecule component and/or the gRNA molecule component described herein, are delivered. In an embodiment, the nucleic acid molecule is delivered at the same time as one or more of the components of the CRISPR/RNA-guided nuclease system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the CRISPR/RNA-guided nuclease system are delivered. In an embodiment, the nucleic acid molecule is delivered by a different means than one or more of the components of the CRISPR/RNA-guided nuclease system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein.

Delivery of RNA Encoding an RNA-Guided Nuclease Molecule

RNA encoding RNA-guided nuclease (e.g., Cas9) and/or gRNA molecules can be delivered into cells, e.g., target cells described herein, by art-known methods or as described herein. For example, Cas9-encoding and/or gRNA-encoding RNA can be delivered, e.g., by microinjection, electroporation, transient cell compression or squeezing (see, e.g., Lee 2012), lipid-mediated transfection, peptide-mediated delivery, or a combination thereof. Cas9-encoding and/or gRNA-encoding RNA can be conjugated to molecules) promoting uptake by the target cells (e.g., target cells described herein).

In an embodiment, delivery via electroporation comprises mixing the cells with the RNA encoding Cas9 molecules and/or gRNA molecules, with or without donor template nucleic acid molecules, in a cartridge, chamber or cuvette and applying one or more electrical impulses of defined duration and amplitude. In an embodiment, delivery via electroporation is performed using a system in which cells are mixed with the RNA encoding Cas9 molecules and/or gRNA molecules, with or without donor template nucleic acid molecules in a vessel connected to a device (e.g., a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the target cells (e.g., target cells described herein).

Delivery of RNA-Guided Nuclease Molecules

RNA-guided nuclease (e.g., Cas9) molecules can be delivered into cells by art-known methods or as described herein. For example, Cas9 protein molecules can be delivered, e.g., by microinjection, electroporation, transient cell compression or squeezing (see, e.g., Lee 2012), lipid-mediated transfection, peptide-mediated delivery, or a combination thereof. Delivery can be accompanied by DNA encoding a gRNA or by a gRNA. Cas9 protein can be conjugated to molecules promoting uptake by the target cells (e.g., target cells described herein).

In an embodiment, delivery via electroporation comprises mixing the cells with the Cas9 molecules and/or gRNA molecules, with or without donor nucleic acid, in a cartridge, chamber or cuvette and applying one or more electrical impulses of defined duration and amplitude. In an embodiment, delivery via electroporation is performed using a system in which cells are mixed with the Cas9 molecules and/or gRNA molecules, with or without donor nucleic acid in a vessel connected to a device (e.g., a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the target cells (e.g., target cells described herein).

Route of Administration of CRISPR/RNA-Guided Nuclease System Components

Systemic modes of administration include oral and parenteral routes. Parenteral routes include, by way of example, intravenous, intraarterial, intramuscular, intradermal, subcutaneous, intranasal, and intraperitoneal routes. Components administered systemically may be modified or formulated to target hepatocytes, liver oval cells, macrophages or monocytes.

Local modes of administration include, by way of example, intraparenchymal delivery to the liver, intrahepatic artery infusion and infusion into the portal vein. In an embodiment, significantly smaller amounts of the components (compared with systemic approaches) may exert an effect when administered locally (for example, directly into the liver parenchyma) compared to when administered systemically (for example, intravenously). Local modes of administration can reduce or eliminate the incidence of potentially toxic side effects that may occur when therapeutically effective amounts of a component are administered systemically.

Administration may be provided as a periodic bolus (for example, intravenously) or as continuous infusion from an internal reservoir or from an external reservoir (for example, from an intravenous bag or implantable pump). Components may be administered locally, for example, by continuous release from a sustained release drug delivery device implanted in the liver.

In addition, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, with the choice of the appropriate system depending on the required rate of release for a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly(caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly(ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly(vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used. Typically the microspheres are composed of a polymer of lactic acid and glycolic acid, which are structured to form hollow spheres. The spheres can be approximately 15-30 microns in diameter and can be loaded with components described herein.

Bi-Modal or Differential Delivery of CRISPR/RNA-Guided Nuclease System Components Separate delivery of CRISPR/RNA-guided nuclease system components, e.g., the Cas9 molecule component and the gRNA molecule component, and more particularly, delivery of the components by differing modes, can enhance performance, e.g., by improving tissue specificity and safety.

In certain embodiments, the Cas9 molecule and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, gRNA molecule, template nucleic acid, or payload. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In an embodiment, a gRNA molecule can be delivered by such modes. The Cas9 molecule component can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In certain embodiments, the first pharmacodynamic or pharmacokinetic property, e.g., distribution, persistence or exposure, is more limited than the second pharmacodynamic or pharmacokinetic property.

In certain embodiments, the first mode of delivery is selected to optimize, e.g., minimize, a pharmacodynamic or pharmacokinetic property, e.g., distribution, persistence or exposure.

In certain embodiments, the second mode of delivery is selected to optimize, e.g., maximize, a pharmacodynamic or pharmacokinetic property, e.g., distribution, persistence or exposure.

In certain embodiments, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In certain embodiments, the second mode of delivery comprises a relatively transient element, e.g., an RNA or protein.

In certain embodiments, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

In certain embodiments, the components, e.g., an RNA-guided-nuclease (e.g., a Cas9 molecule), a gRNA molecule, and a template nucleic acid (e.g., ssODN), may be delivered through, without limitation, (1) viral delivery of RNA-guided nuclease (e.g., Cas9 molecule) coding sequences, viral delivery of gRNA sequence, and non-viral delivery of ssODN, (2) viral delivery of RNA-guided nuclease (e.g., Cas9 molecule) coding sequences, non-viral delivery of gRNA sequence, and non-viral delivery of ssODN, (3) non-viral delivery of RNA-guided nuclease (e.g., Cas9 molecule) DNA or mRNA, viral delivery of gRNA sequence, non-viral delivery of ssODN, or (4) non-viral delivery of RNA-guided nuclease (e.g., Cas9 molecule)-gRNA RNP complexes and non-viral delivery of ssODN.

Furthermore, the components can be delivered in different molecular form or with different delivery vectors that complement one another to enhance safety and tissue specificity.

Use of differential delivery modes can enhance performance, safety, and/or efficacy, e.g., the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In certain embodiments, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

Ex Vivo Delivery of CRISPR/RNA-Guided Nuclease System Components

In certain embodiments, CRISPR/RNA-guided nuclease (e.g., Cas9) system components described in Table 3 are introduced into cells which are then introduced into the subject. Methods of introducing the components can include, e.g., any of the delivery methods described in Table 4.

Modified Nucleosides. Nucleotides. And Nucleic Acids

Modified nucleosides and modified nucleotides can be present in nucleic acids, e.g., particularly gRNA, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose sugar, e.g., of the 2' hydroxyl on the ribose sugar;

(iii) wholesale replacement of the phosphate moiety with "dephospho" linkers;

(iv) modification or replacement of a naturally occurring nucleobase;

(v) replacement or modification of the ribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA is modified, e.g., all bases have a modified phosphate group, e.g., all are phosphorothioate groups. In an embodiment, all, or substantially all, of the phosphate groups of a unimolecular or modular gRNA molecule are replaced with phosphorothioate groups.

In an embodiment, modified nucleotides, e.g., nucleotides having modifications as described herein, can be incorporated into a nucleic acid, e.g., a "modified nucleic acid." In an embodiment, the modified nucleic acids comprise one, two, three or more modified nucleotides. In an embodiment, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In an embodiment, the modified nucleosides, modified nucleotides, and modified nucleic acids described herein can exhibit a reduced innate immune response when introduced into a population of cells, both in vive and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In an embodiment, the modified nucleosides, modified nucleotides, and modified nucleic acids described herein can disrupt binding of a major groove interacting partner with the nucleic acid. In an embodiment, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In an embodiment, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications
Phosphate Group

In an embodiment, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In an embodiment, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In an embodiment, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In an embodiment, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In an embodiment, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In an embodiment, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In an embodiment, modifications to the 2' hydroxyl group can enhance the stability of the nucleic acid since the hydroxyl can no longer be*deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)CH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In an embodiment, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In an embodiment, the "oxy"-2' hydroxyl group modification can include the methoxyethyl group (MOE); $(OCH_2CH_2OCH_3$, e.g., a PEG derivative).

"Deoxy" modifications can include hydrogen (i.e., deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g., L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In an embodiment, the modified nucleotides can include multicyclic forms (e.g., tricyclic; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In an embodiment, the nucleobase can include, for example, naturally-occurring and synthetic derivatives of a base.

Uracil

In an embodiment, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine ($ho^5U$), 5-aminoallyl-uridine, 5-halo-uridine (e.g., 5-iodo-uridine or 5-bromo-uridine), 3-methyl-uridine ($m^3U$), 5-methoxy-uridine ($mo^5U$), uridine 5-oxyacetic acid ($cmo^5U$), uridine 5-oxyacetic acid methyl ester ($mcmo^5U$), 5-carboxymethyl-uridine ($cm^5U$), 1-carboxymethyl-pseudouridine, 5-carboxyhydroxymethyl-uridine ($chm^5U$), 5-carboxyhydroxymethyl-uridine methyl ester ($mchm^5U$), 5-methoxycarbonylmethyl-uridine ($mcm^5U$), 5-methoxycarbonylmethyl-2-thio-uridine ($mcm^5s2U$), 5-aminomethyl-2-thio-uridine ($nm^5s2U$), 5-methylaminomethyl-uridine ($mnm^5U$), 5-methylaminomethyl-2-thio-uridine ($mnm^5s2U$), 5-methylaminomethyl-2-seleno-uridine ($mnm^5se^2U$), 5-carbamoylmethyl-uridine ($ncm^5U$), 5-carboxymethylaminomethyl-uridine ($cmnm^5U$), 5-carboxymethylaminomethyl-2-thio-uridine ($cmnm^5s2U$), 5-propynyl-uridine, 1-propynyl-pseudouridine, 5-taurinomethyl-uridine ($\tau cm^5U$), 1-taurinomethyl-pseudouridine, 5-taurinomethyl-2-thio-uridine($\tau m^5s2U$), 1-taurinomethyl-4-thio-pseudouridine, 5-methyl-uridine ($m^5U$, i.e., having the nucleobase deoxythymine), 1-methyl-pseudouridine (m¹ψ), 5-methyl-2-thio-uridine (m⁵s2U), 1-methyl-4-thio-pseudouridine (m¹s⁴ψ), 4-thio-1-methyl-pseudouridine, 3-methyl-pseudouridine (m³W), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m⁵D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine (acp³U), 1-methyl-3-(3-amino-3-carboxypropyl)pseudouridine (acp³ψ), 5-(isopentenylaminomethyl)uridine (inm⁵U), 5-(isopentenylaminomethyl)-2-thio-uridine (inm⁵s2U), α-thio-uridine, 2'-O-methyl-uridine (Um), 5,2'-O-dimethyl-uridine (m⁵Um), 2'-O-methyl-pseudouridine (ψm), 2-thio-2'-O-methyl-uridine (s2Um), 5-methoxycarbonylmethyl-2'-O-methyl-uridine (mcm⁵Um), 5-carbamoylmethyl-2'-O-methyl-uridine (mcm⁵Um), 5-carboxymethylaminomethyl-2'-O-methyl-uridine (cmnm⁵Um), 3,2'-O-dimethyl-uridine (m³Um), 5-(isopentenylaminomethyl)-2'-O-methyl-uridine (inm⁵Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In an embodiment, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m³C), N4-acetyl-cytidine (act), 5-formyl-cytidine (f⁵C), N4-methyl-cytidine (m⁴C), 5-methyl-cytidine (m⁵C), 5-halo-cytidine (e.g., 5-iodo-cytidine), 5-hydroxymethyl-cytidine (hm⁵C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k²C), α-thio-cytidine, 2'-O-methyl-cytidine (Cm), 5,2'-O-dimethyl-cytidine (m⁵Cm), N4-acetyl-2'-O-methyl-cytidine (ac⁴Cm), N4,2'-O-dimethyl-cytidine (m⁴Cm), 5-formyl-2'-O-methyl-cytidine (f⁵Cm), N4,N4,2'-O-trimethyl-cytidine (m⁴₂Cm), 1-thio-cytidine, 2'-F-ara-cytidine, 2'-F-cytidine, and 2'-OH-ara-cytidine.

Adenine

In an embodiment, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenosine, 7-deaza-8-aza-adenosine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m¹A), 2-methyl-adenosine (m²A), N6-methyl-adenosine (m⁶A), 2-methylthio-N6-methyl-adenosine (ms2 m⁶A), N6-isopentenyl-adenosine (i⁶A), 2-methylthio-N6-isopentenyl-adenosine (ms²i⁶A), N6-(cis-hydroxyisopentenyl)adenosine (i⁶A), 2-methylthio-N6-(cis-hydroxyisopentenyl)adenosine (ms2io⁶A), N6-glycinylcarbamoyl-adenosine (g⁶A), N6-threonylcarbamoyl-adenosine (t⁶A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m⁶₂A), N6-hydroxynorvalylcarbamoyl-adenosine (hn⁶A), 2-methylthio-N6-hydroxynorvalylcarbamoyl-adenosine (ms2hn⁶A), N6-acetyl-adenosine (ac⁶A), 7-methyl-adenosine, 2-methylthio-adenosine, 2-methoxy-adenosine, α-thio-adenosine, 2'-O-methyl-adenosine (Am), N⁶,2'-O-dimethyl-adenosine (m⁶Am), N⁶-Methyl-2'-deoxyadenosine, N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In an embodiment, the modified nucleobase is a modified guanine. Exemplary nucleobases and nucleosides having a modified guanine include without limitation inosine (1), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ₀), 7-aminomethyl-7-deaza-guanosine (preQ₁), archaeosine (G⁺), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m¹G), N2-methyl-guanosine (m²G), N2,N2-dimethyl-guanosine (m²₂G), N2,7-dimethyl-guanosine (m²,7G), N2,N2,7-dimethyl-guanosine (m²,2,7G), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m² 2Gm), 1-methyl-2'-O-methyl-guanosine (m'Gm), N2,7-dimethyl-2'-O-methyl-guanosine (m²,7Gm), 2'-O-methyl-inosine (Im), 1,2'-O-dimethyl-inosine (m'Im), O⁶-phenyl-2'-deoxyinosine, 2'-O-ribosylguanosine (phosphate) (Gr(p)), 1-thio-guanosine, O⁶-methyl-guanosine, O⁶-Methyl-2'-deoxyguanosine, 2'-F-ara-guanosine, and 2'-F-guanosine.

Exemplary Modified gRNAs

In some embodiments, the modified nucleic acids can be modified gRNAs. It is to be understood that any of the gRNAs described herein can be modified in accordance with this section, including any gRNA that comprises a targeting domain from SEQ ID NOs:253-2190.

As discussed above, transiently expressed or delivered nucleic acids can be prone to degradation by, e.g., cellular nucleases. Accordingly, in one aspect the modified gRNAs described herein can contain one or more modified nucleosides or nucleotides which introduce stability toward nucleases. While not wishing to be bound by theory it is also believed that certain modified gRNAs described herein can exhibit a reduced innate immune response when introduced into a population of cells, particularly the cells of the present invention. As noted above, the term "innate immune response" includes a cellular response to exogenous nucleic acids, including single stranded nucleic acids, generally of viral or bacterial origin, which involves the induction of cytokine expression and release, particularly the interferons, and cell death.

While some of the exemplary modification discussed in this section may be included at any position within the gRNA sequence, in some embodiments, a gRNA comprises a modification at or near its 5' end (e.g., within 1-10, 1-5, or 1-2 nucleotides of its 5' end). In some embodiments, a gRNA comprises a modification at or near its 3' end (e.g., within 1-10, 1-5, or 1-2 nucleotides of its 3' end). In some embodiments, a gRNA comprises both a modification at or near its 5' end and a modification at or near its 3' end.

In an embodiment, the 5' end of a gRNA is modified by the inclusion of a eukaryotic mRNA cap structure or cap analog (e.g., a G(5')ppp(5')G cap analog, a m7G(5')ppp(5')G cap analog, or a 3'-O-Me-m7G(5')ppp(5')G anti reverse cap analog (ARCA)). The cap or cap analog can be included during either chemical synthesis or in vitro transcription of the gRNA.

In an embodiment, an in vitro transcribed gRNA is modified by treatment with a phosphatase (e.g., calf intestinal alkaline phosphatase) to remove the 5' triphosphate group.

In an embodiment, the 3' end of a gRNA is modified by the addition of one or more (e.g., 25-200) adenine (A) residues. The polyA tract can be contained in the nucleic acid (e.g., plasmid, PCR product, viral genome) encoding the gRNA, or can be added to the gRNA during chemical synthesis, or following in vitro transcription using a polyadenosine polymerase (e.g., E. coli Poly(A)Polymerase).

In an embodiment, in vitro transcribed gRNA contains both a 5' cap structure or cap analog and a 3' polyA tract. In an embodiment, an in vitro transcribed gRNA is modified by treatment with a phosphatase (e.g., calf intestinal alkaline phosphatase) to remove the 5' triphosphate group and comprises a 3' polyA tract.

In some embodiments, gRNAs can be modified at a 3' terminal U ribose. For example, the two terminal hydroxyl groups of the U ribose can be oxidized to aldehyde groups and a concomitant opening of the ribose ring to afford a modified nucleoside as shown below:

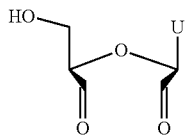

wherein "U" can be an unmodified or modified uridine.

In another embodiment, the 3' terminal U can be modified with a 2'3' cyclic phosphate as shown below:

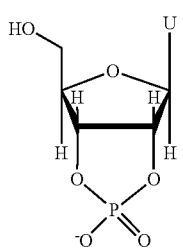

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein.

In some embodiments, sugar-modified ribonucleotides can be incorporated into the gRNA, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., $NH_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, one or more of the nucleotides of the gRNA can each independently be a modified or unmodified nucleotide including, but not limited to 2'-sugar modified, such as, 2'-O-methyl, 2'-O-methoxyethyl, or 2'-Fluoro modified including, e.g., 2'-F or 2'-O-methyl, adenosine (A), 2'-F or 2'-O-methyl, cytidine (C), 2'-F or 2'-O-methyl, uridine (U), 2'-F or 2'-O-methyl, thymidine (T), 2'-F or 2'-O-methyl, guanosine (G), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In some embodiments, a gRNA can include "locked" nucleic acids (LNA) in which the 2' OH-group can be connected, e.g., by a C1-6 alkylene or C1-6 heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy or $O(CH_2)_n$-amino (wherein amino can be, e.g., $NH_2$; alkylamino, dialkylamino, heterocyclyl, arylamino, diarylamino, heteroarylamino, or diheteroarylamino, ethylenediamine, or polyamino).

In some embodiments, a gRNA can include a modified nucleotide which is multicyclic (e.g., tricyclo; and "unlocked" forms, such as glycol nucleic acid (GNA) (e.g., R-GNA or S-GNA, where ribose is replaced by glycol units attached to phosphodiester bonds), or threose nucleic acid (TNA, where ribose is replaced with α-L-threofuranosyl-(3'-2')).

Generally, gRNA molecules include the sugar group ribose, which is a 5-membered ring having an oxygen. Exemplary modified gRNAs can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). Although the majority of sugar analog alterations are localized to the 2' position, other sites are amenable to modification, including the 4' position. In an embodiment, a gRNA comprises a 4'-S, 4'-Se or a 4'-C-aminomethyl-2'-O-Me modification.

In some embodiments, deaza nucleotides, e.g., 7-deaza-adenosine, can be incorporated into the gRNA. In some embodiments, O- and N-alkylated nucleotides, e.g., N6-methyl adenosine, can be incorporated into the gRNA.

In some embodiments, one or more or all of the nucleotides in a gRNA molecule are deoxynucleotides.

miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory, it is believed that this down regulation occurs by either reducing nucleic acid molecule stability or inhibiting translation. An RNA species disclosed herein, e.g., an mRNA encoding Cas9, can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

EXAMPLES

The following Examples are merely illustrative and are not intended to limit the scope or content of the invention in any way.

Example 1: Cloning and Initial Screening of gRNAs

This example discloses a method for evaluating chimeric gRNAs. The same approach may also be used to evaluate modular gRNAs.

Cloning gRNAs into Vectors gRNA candidates targeting Exon II of human SERPINA1 were identified using a custom bioinformatics tool for guide RNA design. For each gRNA, a pair of overlapping oligonucleotides was designed and obtained. Oligonucleotides were annealed and ligated into a digested vector backbone containing an upstream U6 promoter and the remaining sequence of a long chimeric gRNA. Plasmids were sequence-verified and prepped to generate sufficient amounts of transfection-quality DNA. In certain embodiments, the U6 promoter may be replaced with an alternate promoter to drive in vivo transcription (e.g., H1 promoter) or in vitro transcription (e.g., a T7 promoter).

Cloning gRNAs into Linear dsDNA Molecules (STITCHR)

Each gRNA was generated as a STITCHR PCR fragment as previously described. A single oligonucleotide was designed and obtained for each gRNA. The U6 promoter and the gRNA scaffold (e.g., including everything except the targeting domain, e.g., including sequences derived from the crRNA and tracrRNA, e.g., including a first complementarity domain; a linking domain; a second complementarity domain; a proximal domain; and a tail domain) were separately PCR amplified and purified as dsDNA molecules. The gRNA-specific oligonucleotide was used in a PCR reaction to stitch together the U6 and the gRNA scaffold, linked by the targeting domain specified in the oligonucleotide. The resulting dsDNA molecules (STITCHR products) were purified for transfection. Any gRNA scaffold may be used to create gRNAs compatible with Cas9s from any bacterial species. In certain embodiments, the U6 promoter may be replaced with an alternate promoter to drive in vivo transcription (e.g., H1 promoter) or in vitro transcription (e.g., T7 promoter).

Initial gRNA Screen

Figure 16A:
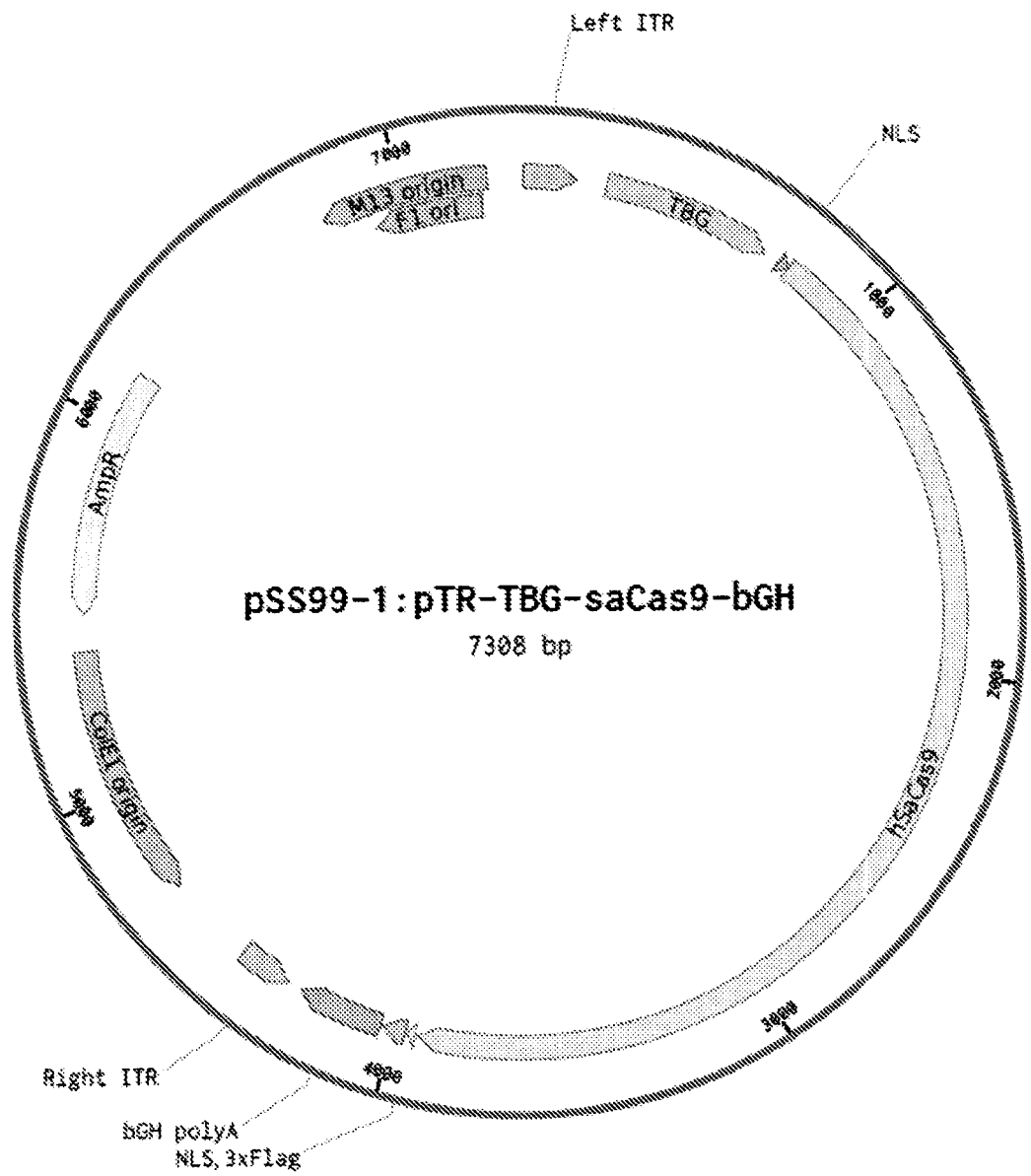
FIG. 16A-M provide schematic representations of various vectors used in the examples herein. (A) pSS99-1: pTR-TBG-saCas9-bGH (7308 bp). (B) pSS99-4: pTR-CMV-saCas9-bGH (7444 bp). (C) pSS111-: pTR-CMV-hAAT-bGH (5483 bp). (D) pSS111: CMV-hAAT-bGH (4509 bp). (E) pSS112: pTR-gRNA-203-EFS comprising targeting domain of SEQ ID NO:1390 (7362 bp). (F) pSS13: pTR-gRNA-333-EFS-minpA comprising targeting domain of SEQ ID NO:1811 (7362 bp). (G) pSS114: pTR-gRNA-203-TBG-minpA comprising targeting domain of SEQ ID NO:1390 (7571 bp). (H) pSS115: pTR-gRNA-333-TBG-minpA comprising targeting domain of SEQ ID NO: 1811 (7571 bp). (I) pMES04: U6-gRNA-1889 comprising the targeting domain of SEQ ID NO:2191 (2280 bp). (J) pMES06: p-TR-gRNAI889Z-1.7kb_hom_HDR comprising the targeting domain of SEQ ID NO:706 (7018 bp). (K) pMES08: p-TR-gRNA 1889Z-2kb-1.4kb_HDR comprising the targeting domain of SEQ ID NO:706 (7018 bp). (L) pSS79: p-CMVsaCas9-BGHpA (6702 bp). (M) pAF003: CMV-saCas9 (6474 bp).
Figure 16B:
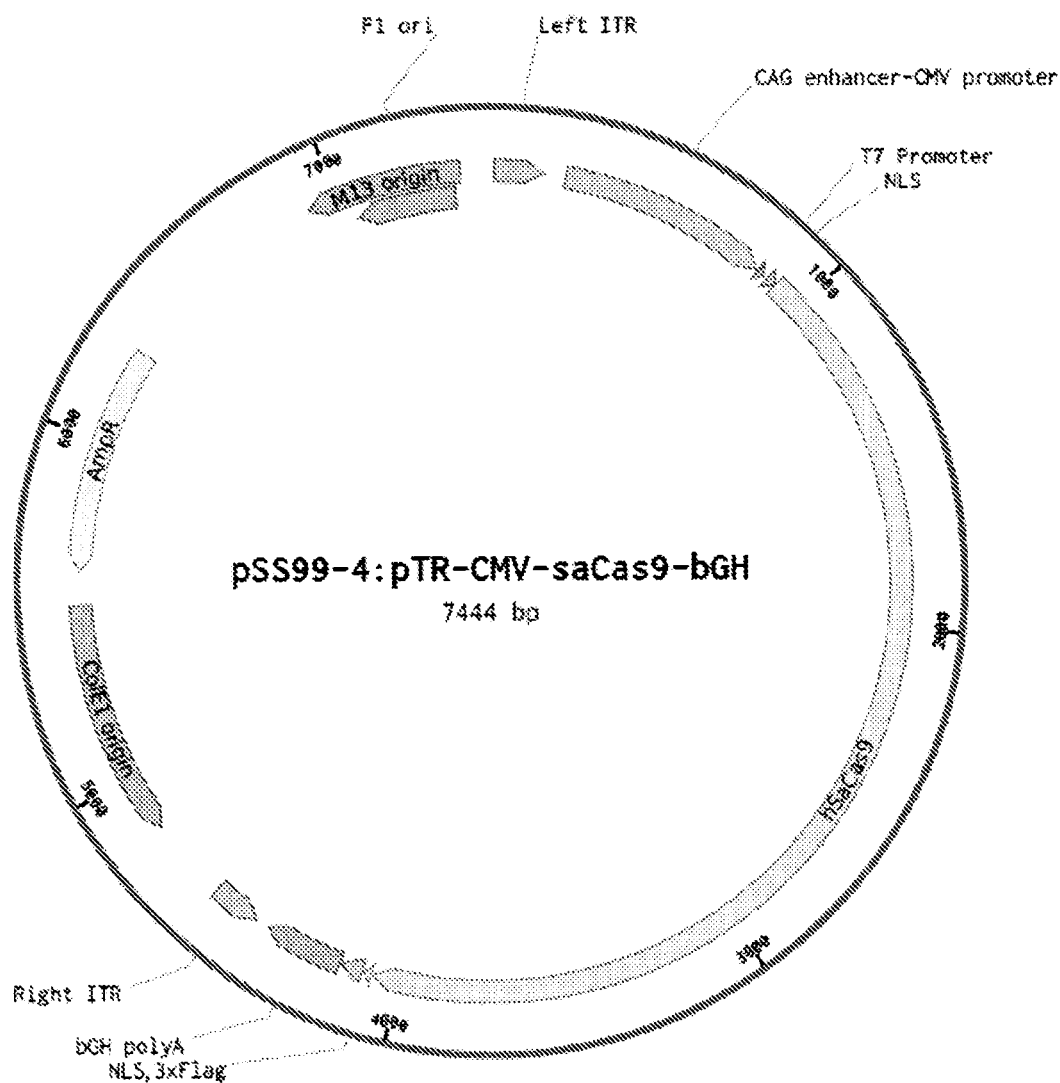
Figure 16C:
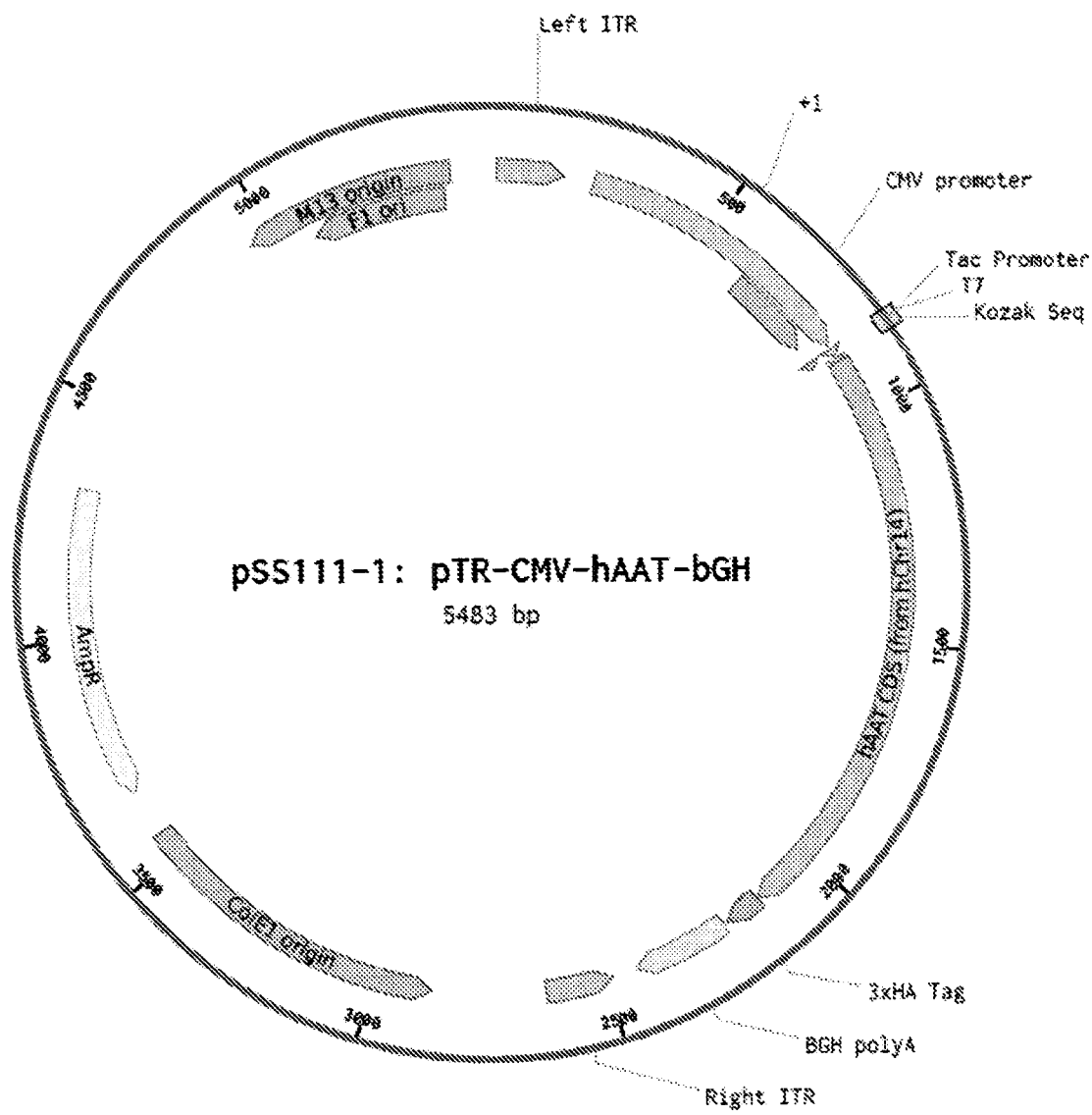
Figure 16D:
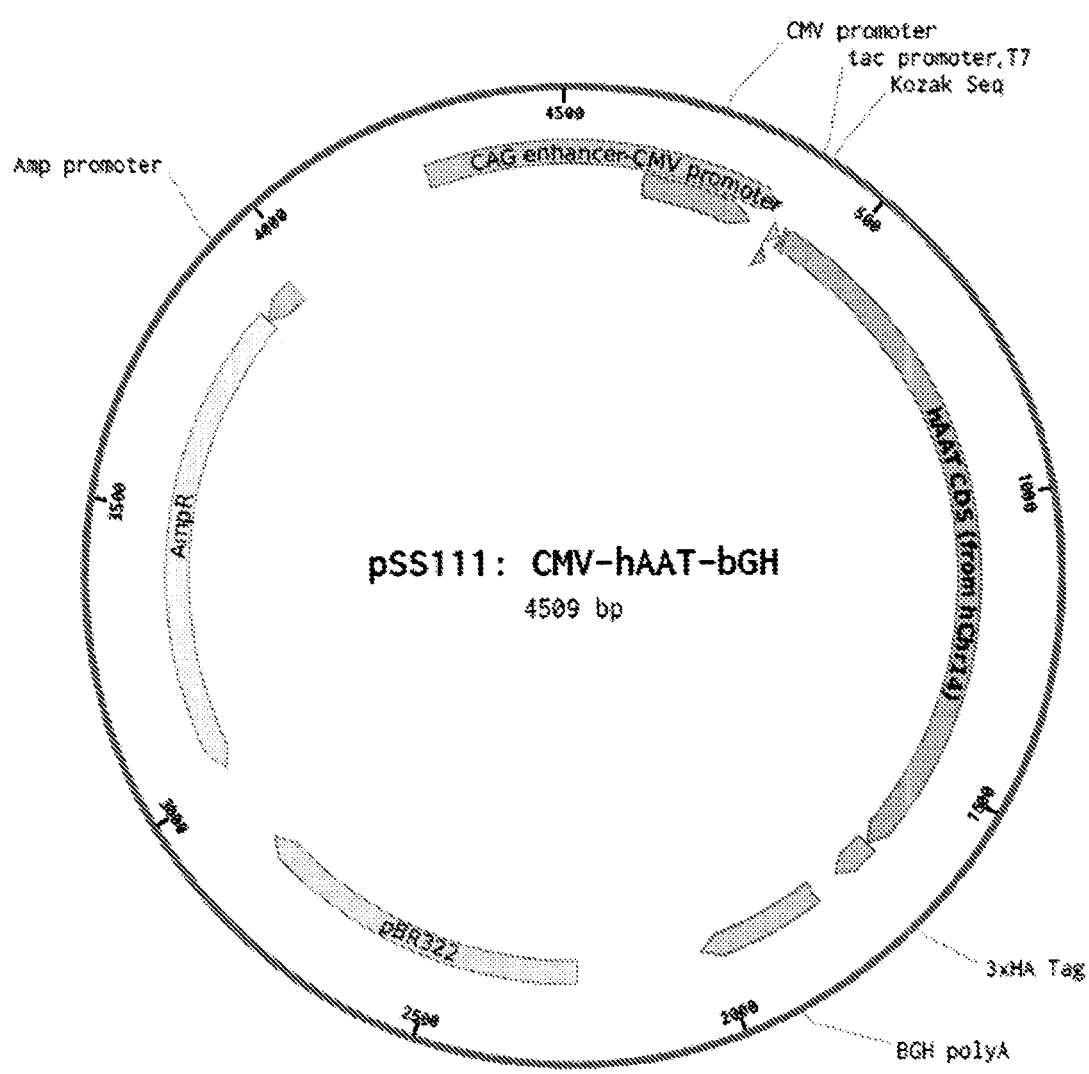
Figure 16E:
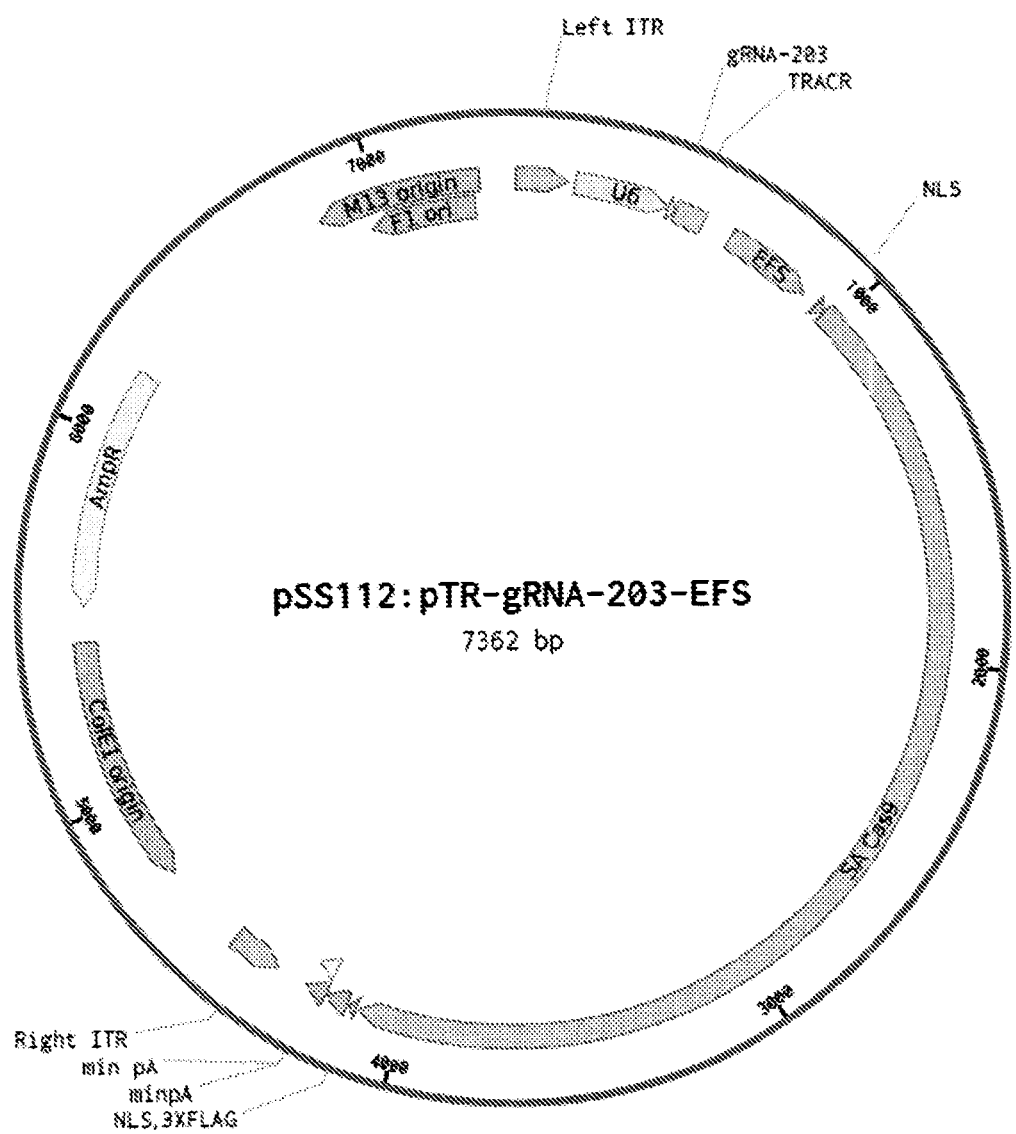
Figure 16F:
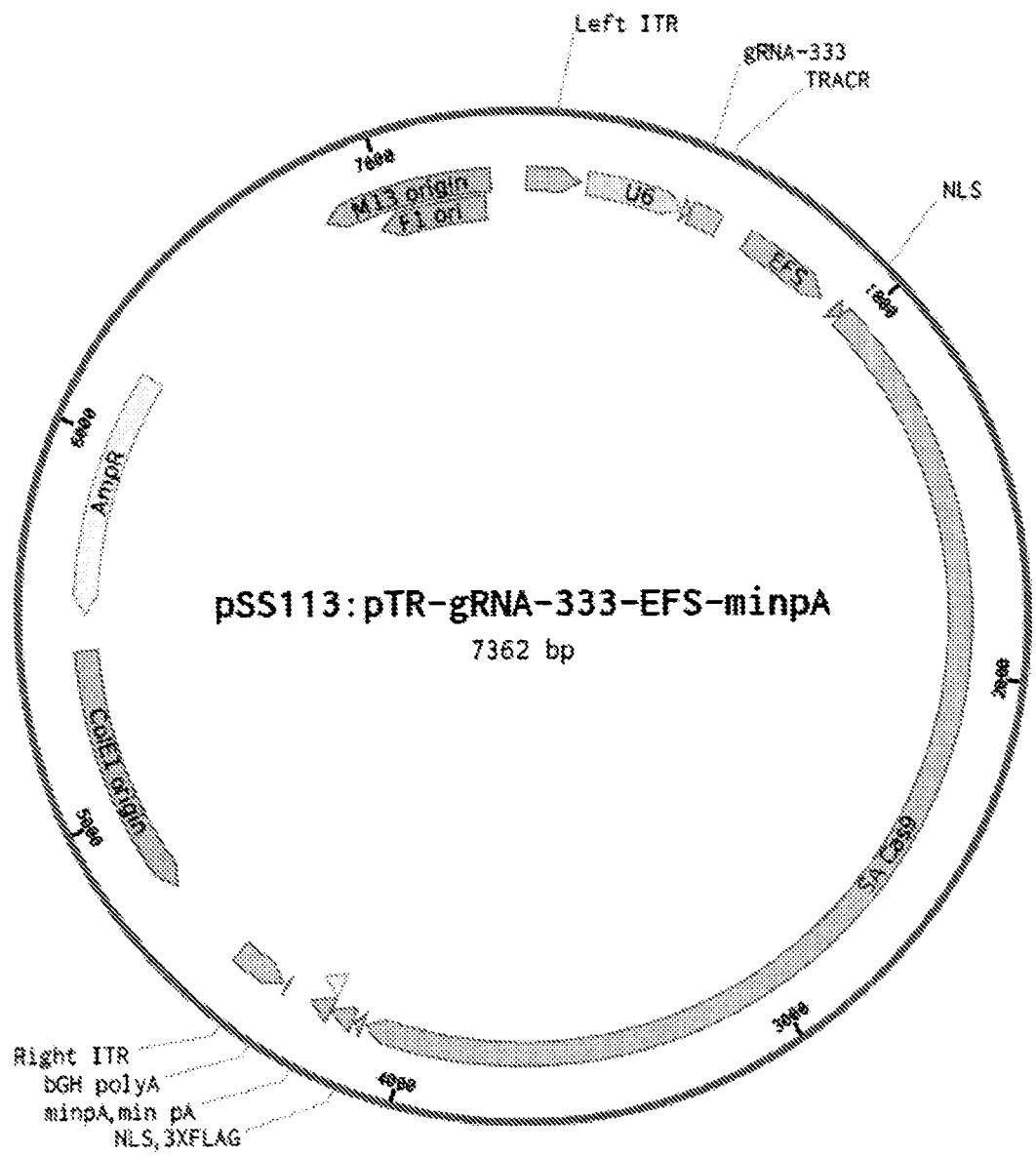
Figure 16G:
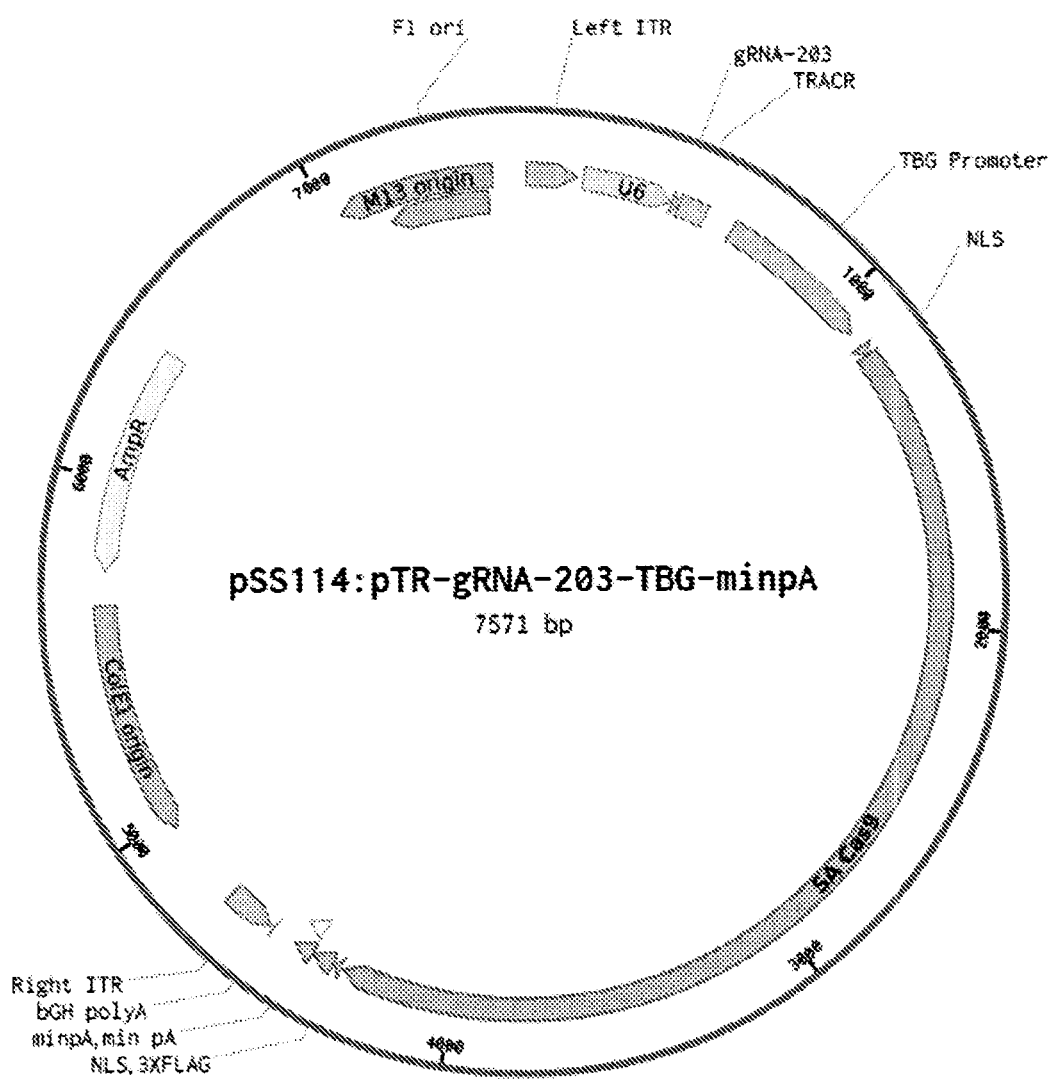
Figure 16H:
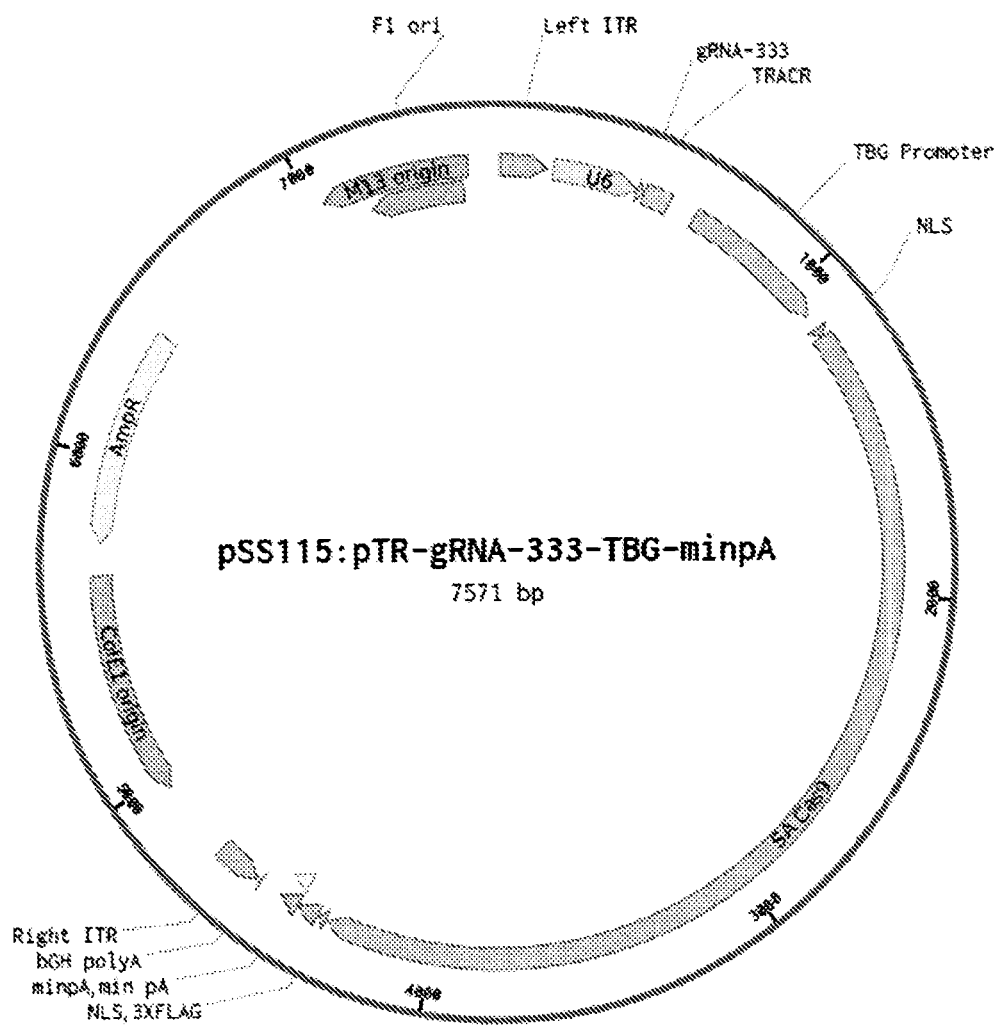
Figure 16I:
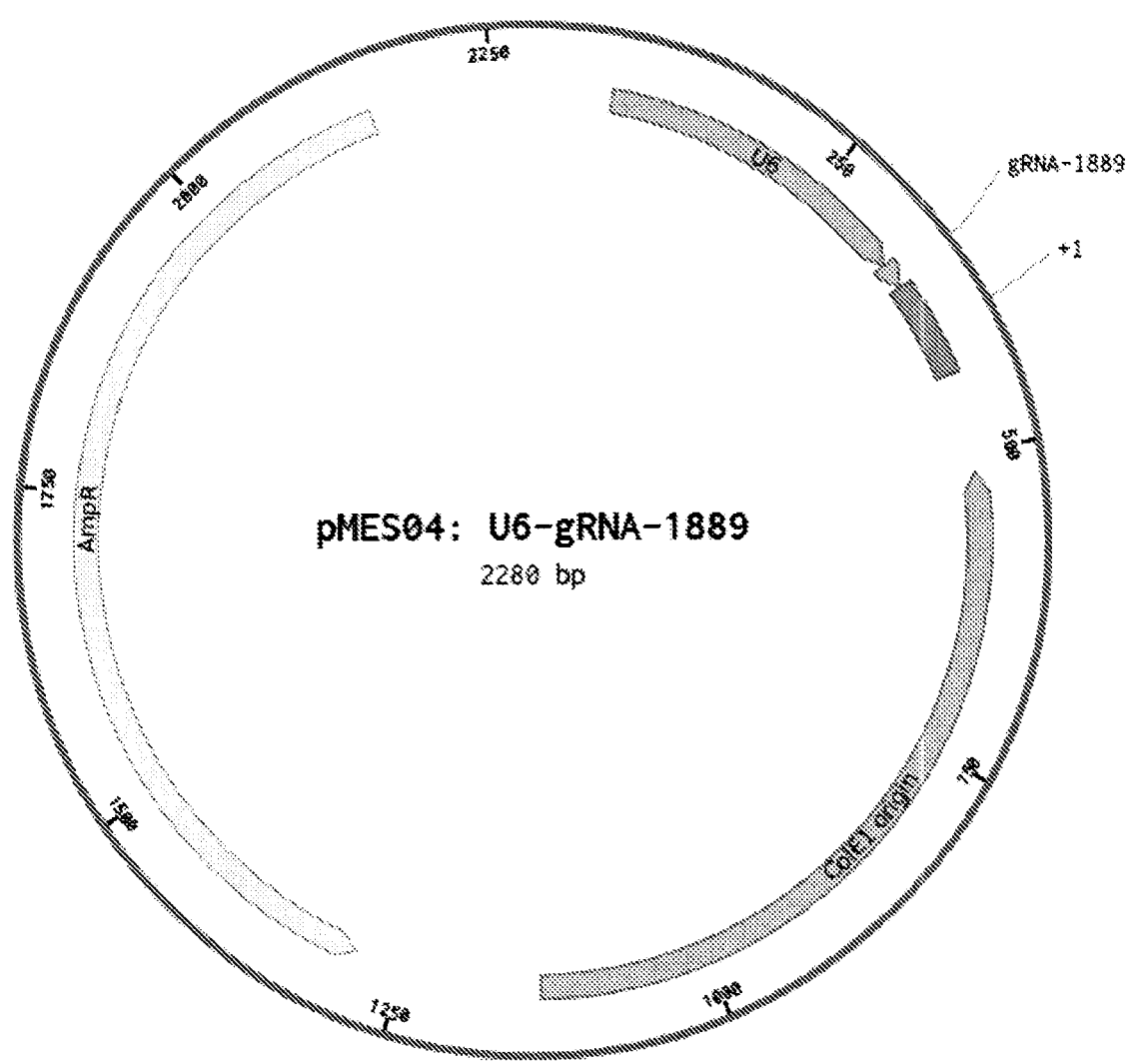
Figure 16J:
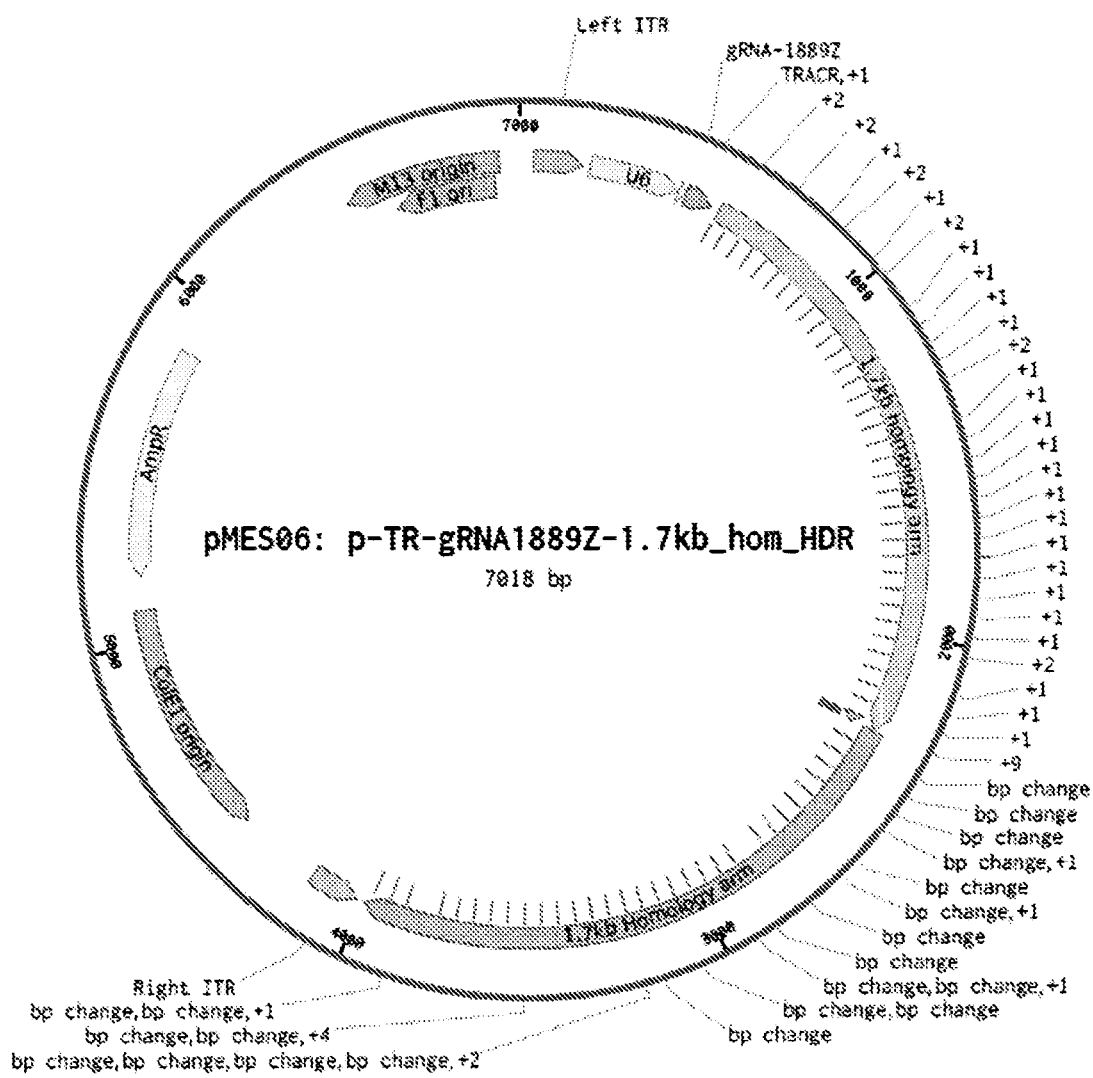
Figure 16K:
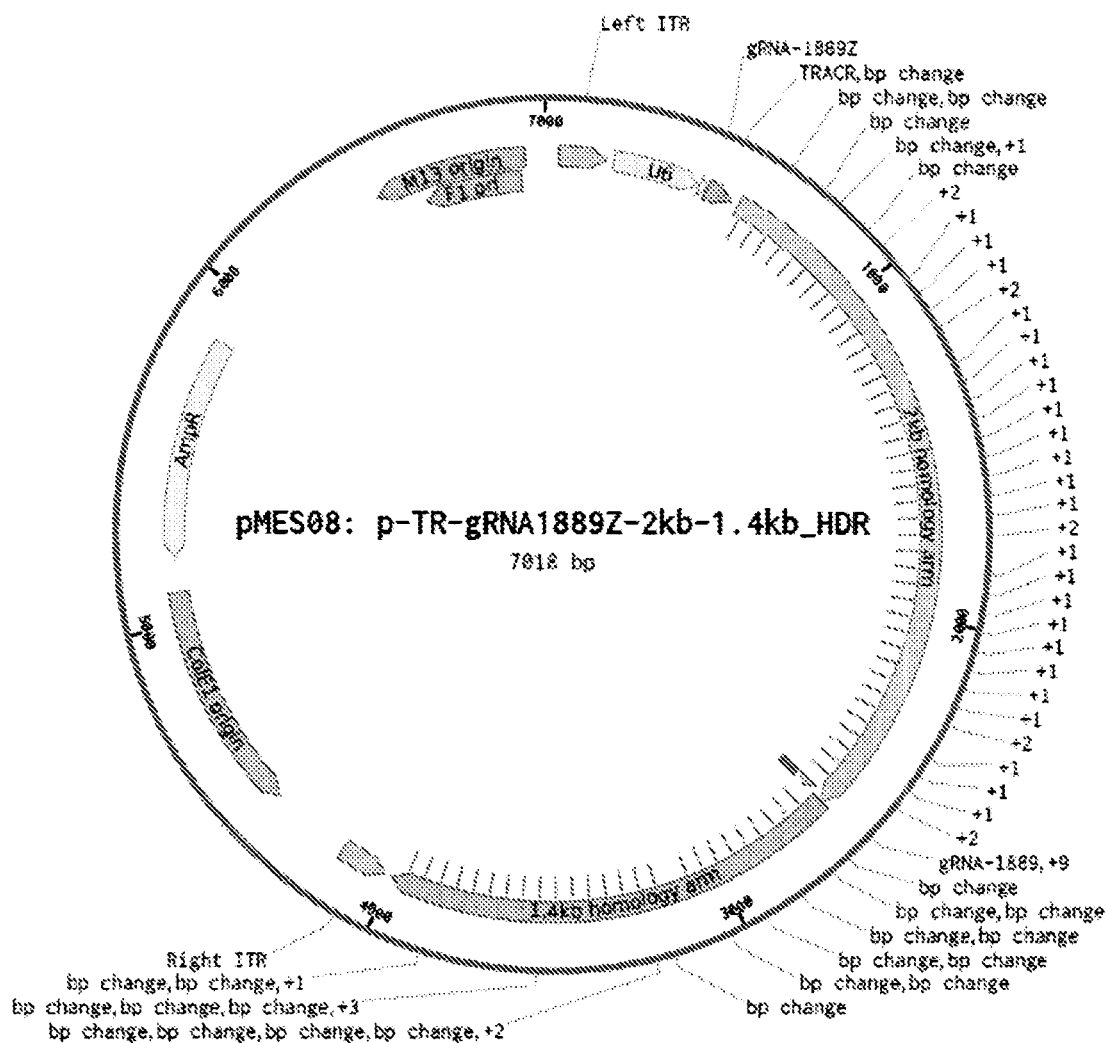
Figure 16L:
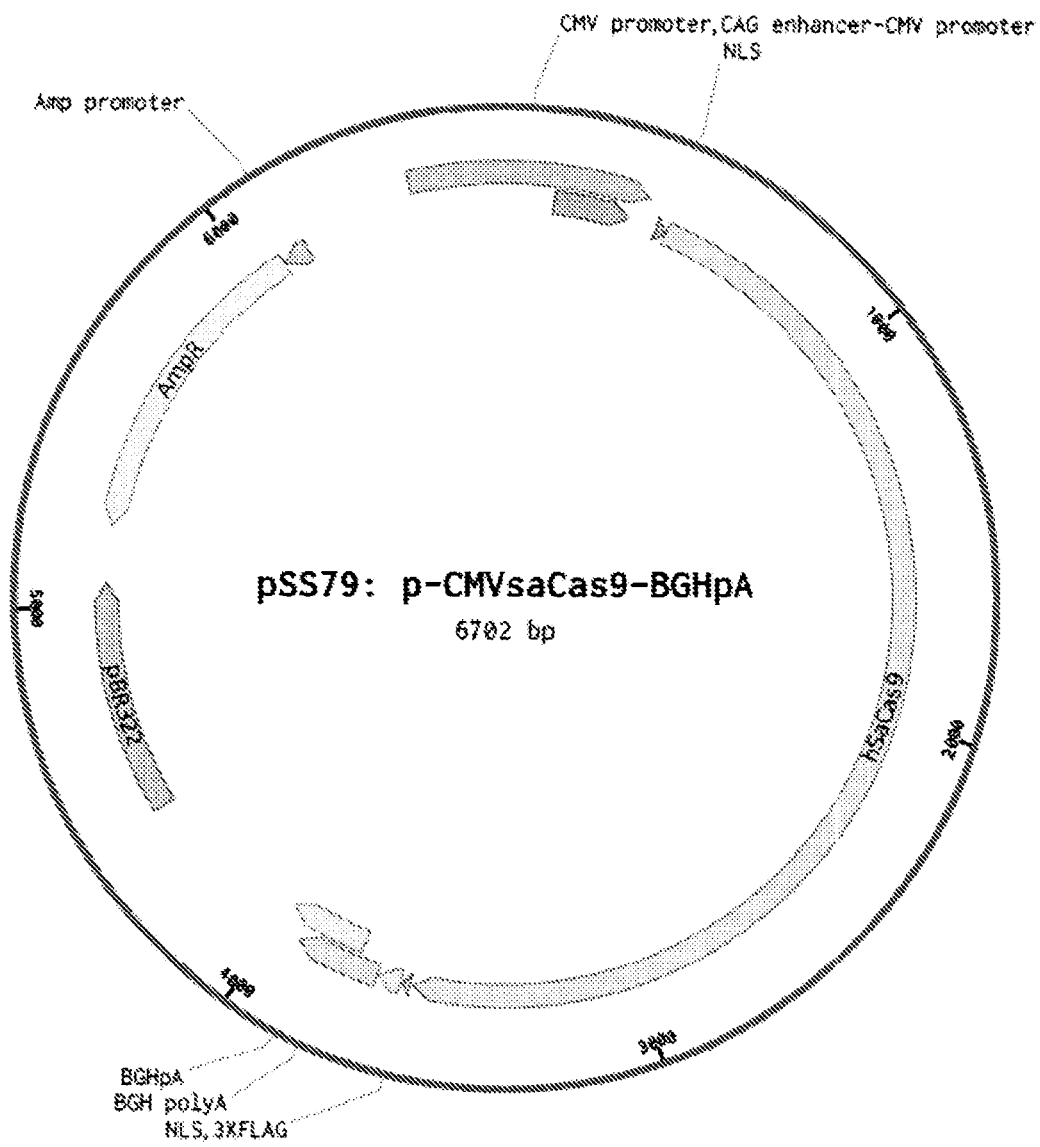
Figure 16M:
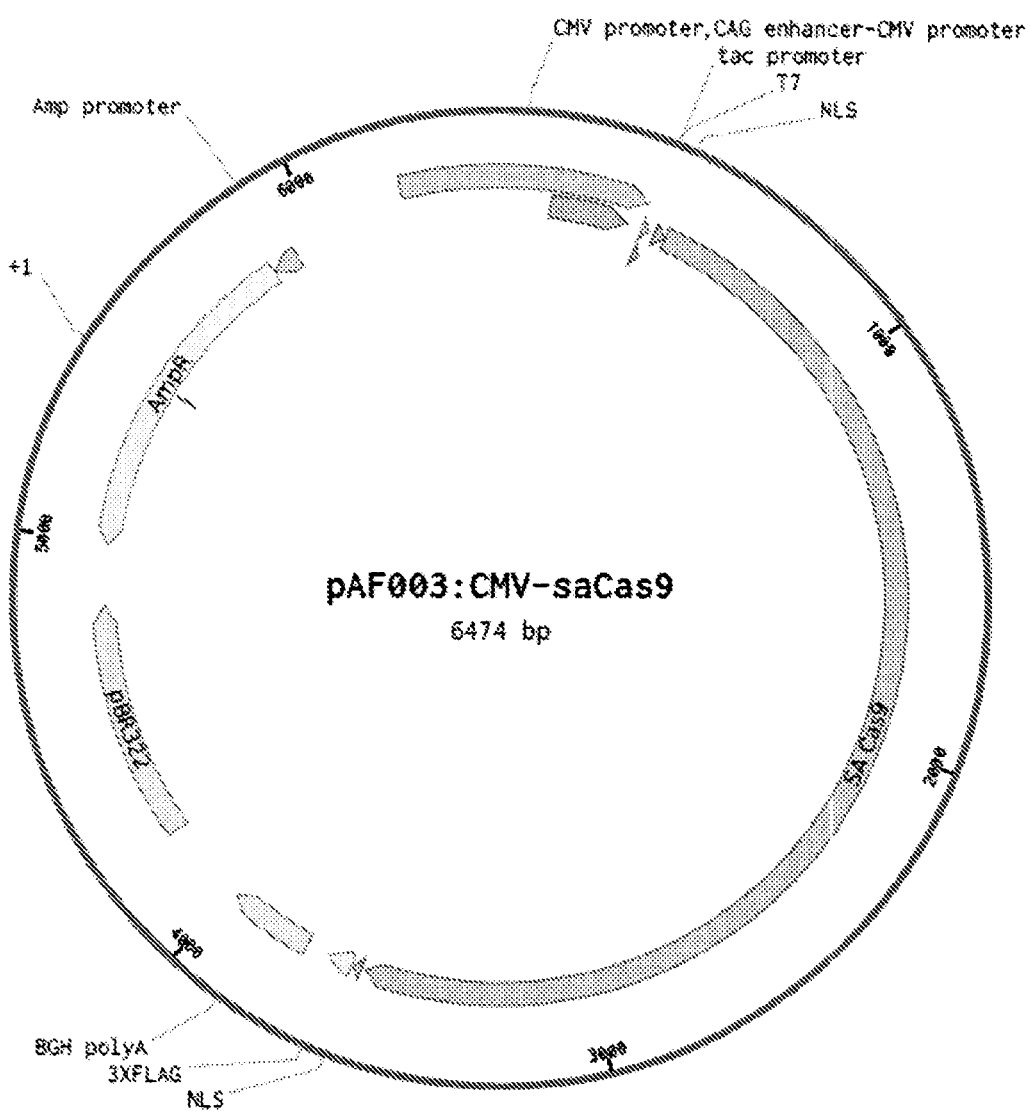

To assess the activity of individual gRNAs, each STITCHR fragment encoding a U6-driven sgRNA was co-transfected with pAF003 into either HEK293 cells or hepatocellular carcinoma cell line Hep3B. The pAF003 plasmid encodes CMV-promoter driven *S. aureus* Cas9 with an N-terminal and a C-terminal Nuclear Localization Signal (NLS) and a C-terminal triple Flag tag (FIG. 16M, FIG. 17M). In certain embodiments, other cell types may be used for screening, including for example immortalized human cell lines such as 293T, K562 or U2OS, or primary human cells. The cells used for screening may be relevant to the eventual therapeutic cell target (e.g., an erythroid cell). The use of primary cells similar to the potential therapeutic target cell population may provide important information on gene targeting rates in the context of endogenous chromatin and gene expression. Transfections can comprise different gRNAs and different targeting approaches (17-mers, 20-mers, nuclease, dual-nickase, etc.) to determine which gRNAs/combinations of gRNAs give the greatest activity.

Figure 9A:
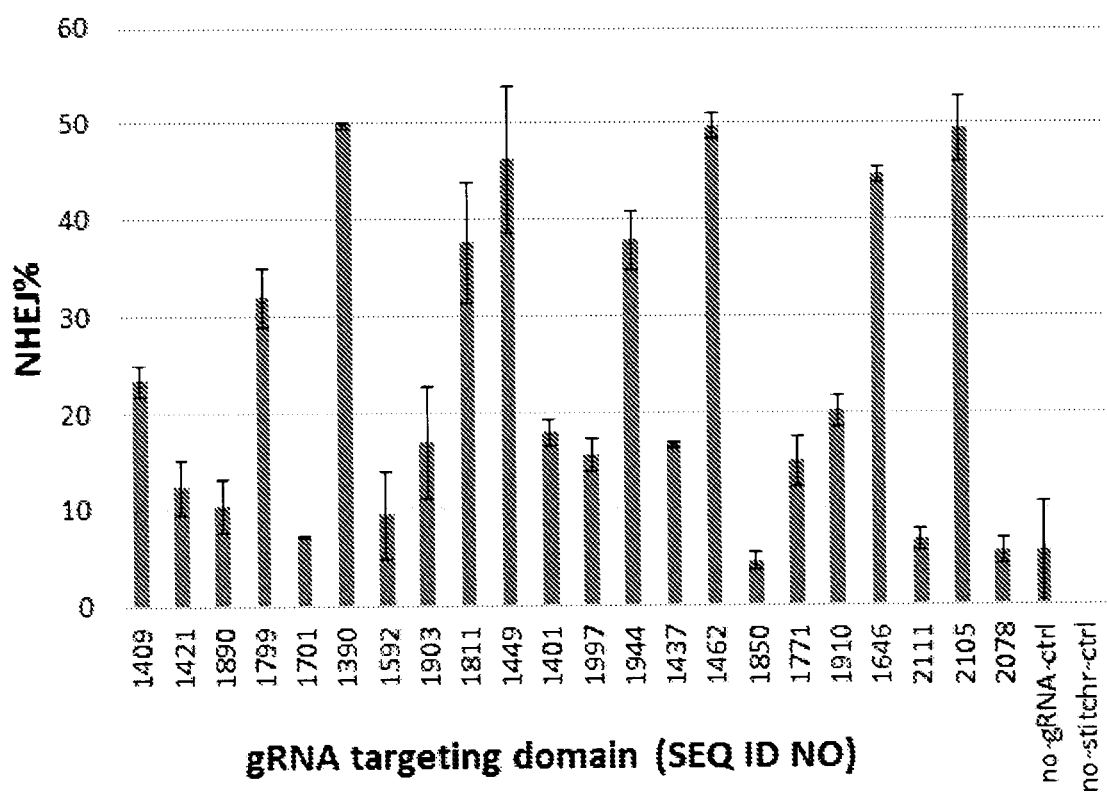
FIG. 9A shows gRNA screening results on Exon II of hSERPINA1 in HEK293 cells.

HEK293 cells were seeded on 24-well plates at a density of 100,000 cells/well 18 hours prior to transfection of STITCHR and pAF003 with Mirus TransIT-293® transfection reagent. Four days post transfection, genomic DNA (gDNA) was isolated from transfected cells followed by PCR amplification of a region of the hSERPINA1 locus encompassing all the potential DNA cleavage sites of the candidate gRNAs. Efficiency of cleavage with each gRNA was assessed by measuring NHEJ-induced indel formation at the target locus by T7E1 endonuclease assay. For the T7E1 assay, PCR amplicons were approximately 500-700 bp with the intended cut site placed asymmetrically in the amplicon. Following amplification, purification, and size-verification of PCR products, DNA was denatured and re-hybridized by heating to 95° C. and then slowly cooling. Hybridized PCR products were then digested with T7 Endonuclease I (or other mismatch-sensitive enzyme), which recognizes and cleaves non-perfectly matched DNA. If indels are present in the original template DNA, denaturation and re-annealing of the amplicons results in hybridization of DNA strands harboring different indels, leading to double-stranded DNA that is not perfectly matched. Digestion products may be visualized by gel electrophoresis or capillary electrophoresis. The fraction of DNA that is cleaved (density of cleavage products divided by the density of cleaved and uncleaved) may be used to estimate percent NHEJ using the following equation: % NHEJ=$(1-(1-\text{fraction cleaved}))^{1/2}$. The T7E1 assay is sensitive down to about 2-5% NHEJ. FIG. 9A shows the rates of indels induced by individual gRNAs at Exon II of hSERPINA1 when co-expressing U6-driven gRNA and saCas9 in HEK293 cells. Error bars represent standard error. Among the 22 gRNAs tested (see Table 10), the highest % NHEJ was observed with the gRNAs SERPINA1-2-r251, SERPINA1-2-r323, and SERPINA1-2-r959 (comprising the targeting domains of SEQ ID NOs:1390, 1462, and 2105, respectively).

Figure 9B:
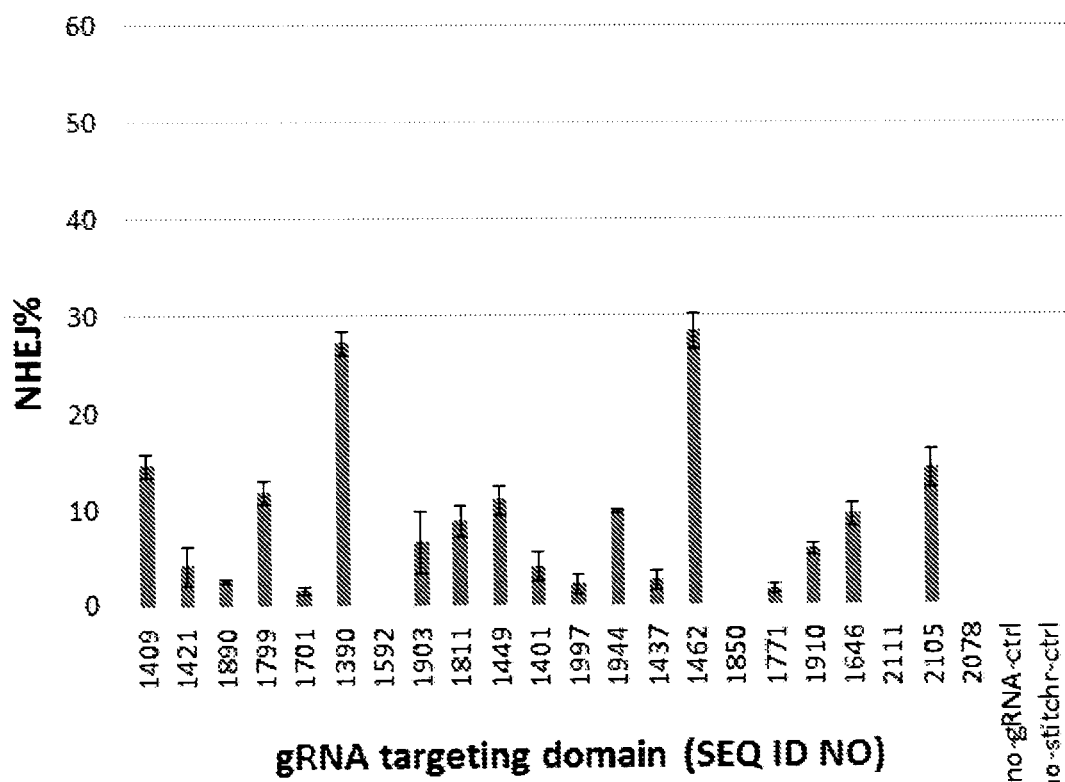
FIG. 9B shows gRNA screening results on Exon II of hSERPINA1 in Hep3B cells.

Hep3B cells were nucleofected with STITCHR fragments and pAF003 using Lonza™ 4D-Nucleofector™ Kit SF with program EH-100. Nucleofection protocol for Hep3B cells was optimized by transfecting GFP-expressing plasmids with multiple nucleofection solutions and pulse codes and assaying GFP expression intensity by fluorescence microscopy within 24 hours. 250 ng of STITCHR and 750 ng of pAF003 were nucleofected into 50,000 Hep3B cells. Five days post nucleofection, gDNA was extracted followed by PCR amplification of hSERPINA1-Exon II and T7E1 endonuclease assay. FIG. 9B demonstrates the indel rates induced by co-expression of gRNA and saCas9 in Hep3B cells. Error bars represent standard error. In Hep3B cells, the highest % NHEJ was observed with the gRNAs SERPINA1-2-r251 and SERPINA1-2-r323 (comprising the targeting domains of SEQ ID NOs: 1390 and 1462, respectively).

In certain embodiments, HEK293 and Hep3B cells (#HB-8064, ATCC, Manassas, Va.) may be maintained and propagated in Dulbecco's Modified Eagle Medium (DMEM) and Eagle's Minimum Essential Medium (EMEM), respectively, and supplemented with 10% fetal bovine serum (FBS) at 37° C. with 5% $CO_2$. In certain embodiments, other methods may be used to assess cleavage efficiency, including for example include sequencing and use of mismatch-sensitive enzymes, e.g., Cell/Surveyor nuclease. For Sanger sequencing, purified PCR amplicons are cloned into a plasmid backbone, transformed, miniprepped and sequenced with a single primer. Sanger sequencing may be used for determining the exact nature of indels after determining the NHEJ rate by T7E1. For next-generation sequencing, amplicons may be 300-500 bp with the intended cut site placed asymmetrically. Following PCR, next-generation sequencing adapters and barcodes (for example Illumina multiplex adapters and indexes) may be added to the ends of the amplicon, e.g., for use in high throughput sequencing (for example on an Illumina MiSeq). This method allows for detection of very low NHEJ rates.

Example 2: Construction and In Vivo Evaluation of gRNA/Cas9 AAV Vector for Knocking Out Expression of A1AT PiZ Allele (Approaches 2A, 2B)

As discussed previously, Alpha-1 antitrypsin deficiency (AATD) is the most common inherited genetic disease in the human liver. The predominant genotype of AATD patients with severe clinical manifestations is homozygous of the PiZ alleles (PiZZ), harboring a Z mutation (E342K) on the SERPINA1 locus. This point mutation at the hinge of the beta barrel and the Reactive Center Loop (RCL) of the AAT protein results in a self-inactivating "loop-sheet" confirmation that aggregates AAT-Z proteins inside the rough Endoplasmic Reticulum (rER) of hepatocytes during synthesis. There are two disease phenotypes associated with AATD. The gain-of-function phenotype stems from the aggregation of misfolded AAT-Z protein in rER, leading to cellular stress, inflammation, fibrosis, cirrhosis, and hepatocellular carcinoma (HCC). The loss-of-function phenotype is associated with the alveoli linings in the lung. AAT, a serum protease inhibitor and one of the most abundant proteins in serum, protects the airway from uncontrolled activity of proteases. The lack of AAT secretion from hepatocytes, together with the inferior elastase inhibitory activity of residual circulating AAT-Z proteins, shifts the balance between AAT and proteases in the lung. Over-digestion of the intracellular junctions and alveoli linings deteriorates the lung elasticity and pulmonary functions, leading to emphysema, a hallmark of Chronic Obstructive Pulmonary Disease (COPD).

The therapeutic options are extremely limited for patients with AATD. A small fraction of patients at the advanced stage of liver disease have undergone liver transplantation. Novel therapeutic regimens, including weekly-dosing of siRNA or Antisense Oligonucleotides (ASOs), have demonstrated promising preclinical and clinical results in reducing the AAT-Z load in hepatocytes. AAT protein augmentation therapy, the current standard-of-care for AATD lung emphysema in the developed world, involves weekly infusions of AAT purified from healthy blood donors, but does not reduce the risk of AATD liver diseases. Therefore, a one-time treatment for both liver and lung diseases presents a promising opportunity. It has been shown previously that the Type II Clustered Regularly Interspaced Short Palindromic Repeats (CRISPR) system from *Staphylococcus aureus* (saCas9) can be packaged into recombinant Adeno-associated Vectors (AAV) for in vivo studies (Ran 2013) because of the smaller coding sequence of saCas9 in contrast to the most well-studied *Streptococcus pyogenes* Cas9 (spCas9). In addition, previous studies demonstrated the therapeutic potential of combining zinc-finger nucleases delivered by AAV and AAV-mediated Homology-directed DNA Repair (HDR) in treating metabolic diseases in the liver (Sharma 2015; Wang 2015).

In this example, a gene editing approach was designed to treat AATD-associated diseases, which is mediated by Non-homologous End Joining (NHEJ) and Nonsense Mediated Decay (NMD) for treating the liver disease. This approach takes advantage of the high transduction efficiencies of hepatocytes by AAV8 viral vectors. As shown herein, an All-in-One AAV8-CRISPR targeting the early coding region of human SERPINA1 (hSERPINA1) significantly reduced the transcription and protein expression in hepatocytes in the adult PiZ transgenic mice. The phenomenon also correlated with down regulation of AAT-Z protein in serum and Periodic Acid-Schiff Staining after Diastase Treatment (PAS-D Staining). These results demonstrated the potential of gene editing strategies in treating genetic diseases with root causes from the liver.

Figure 18A:
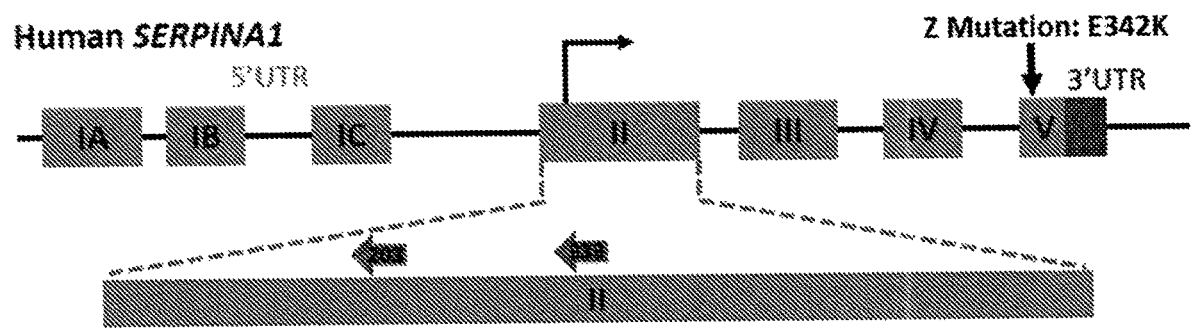
FIGS. 18A-F provides schematics and data related to gene disruption and transcription modifications of hSERPINA1 by AAV8-CRISPR in PiZ transgenic mice.

All-in-One AAV8-CRISPR Vectors Disrupt hSERPINA1 Loci in PiZ Transgenic Mice gRNA/Cas9 product prototypes were evaluated in PiZ transgenic mice to assess their efficiency and efficacy in knocking out expression of A1AT PiZ alleles in the liver. Two guide RNAs identified in Example 1 were selected for in vive experiments: sgRNA-203 (also named SERPINA1-2-r251, Table 10) comprising the targeting domain of SEQ ID NO: 1390, a G-initiating sequence with an NNGRRT PAM, and the most potent gRNA assayed in both cell lines; and sgRNA-333 (also named SERPINA1-2-r667, Table 10) comprising the targeting domain of SEQ ID NO:1811, an A-initiating sequence with an NNGRRV PAM. FIG. 18A shows the schematic representation of sgRNA-203 and sgRNA-333 on the human SERPINA1 locus.

Figure 18B:
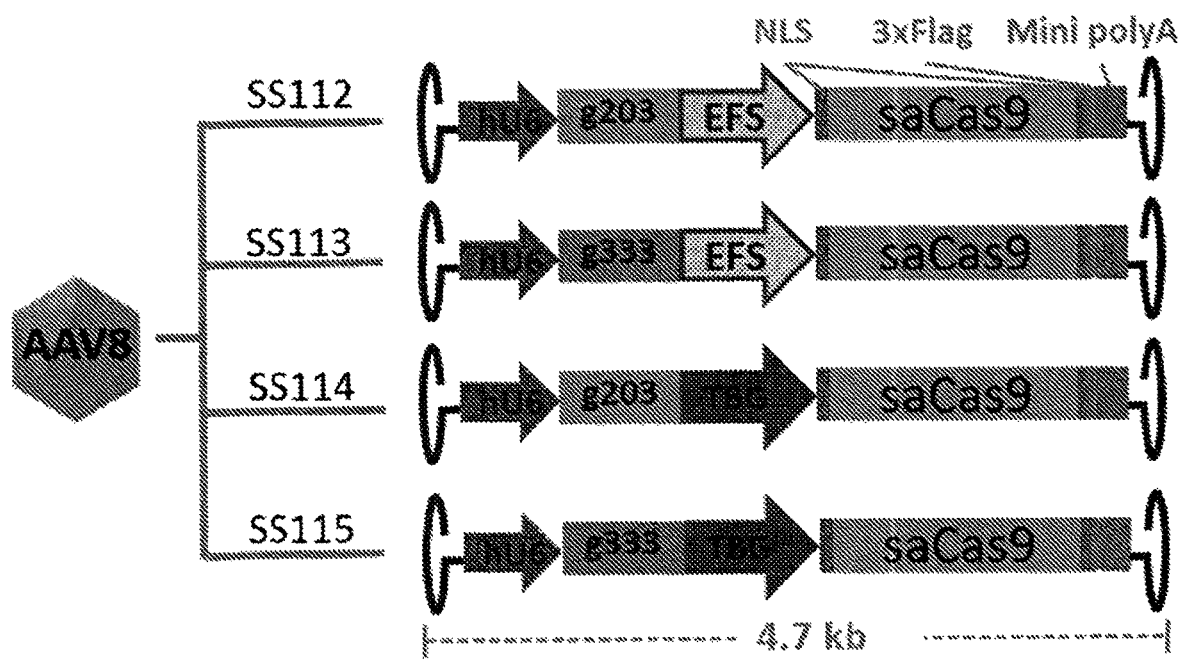

It is well established that AAV8 is the most potent and naturally-occurring AAV serotype capable of transducing liver across species, from mice to dogs to non-human primates. Therefore, the complete transgenes flanked by Inverted Terminal Repeats (ITRs) from the wildtype AAV2 genome were packaged into AAV8 capsids for in vivo studies (FIG. 18B). Four AAV8-CRISPR vectors (i.e., AAV-SS112, AAV-SS113, AAV-SS114, and AAV-SS115) were constructed to evaluate the contributions of two components in the vector system in achieving high gene editing in vivo. The overall configurations of AAV8-CRISPR were identical: an sgRNA driven by a human U6 promoter and saCas9 coding sequence flanked by two nuclear localization signals (NLS) and one C-terminal triple Flag tag. The two variable components were: (1) the targeting sequence of the sgRNA, sg203 or sg333; and (2) the promoter driving saCas9 expression, ubiquitous EFS promoter or liver-specific human Thyroxine Binding Globulin (TBG) promoter.

Briefly, plasmids containing the TBG promoter, EFS promoter, U6-driven sgRNA with different target sequences, saCas9, NLS's, a triple flag tag, and homology arms were synthesized. These components were cloned into the pTR-UF-11 plasmid (#MBA-331, ATCC, Manassas, Va.) to obtain the All-in-One AAV8-CRISPR vectors. Multiple cloning sites at the junction of each component allow subcloning of different elements in this AAV8-CRISPR vector system. All AAV vectors were designed and cloned to be within the 4.7 kb packaging limit including both ITRs. The proviral vectors were packaged into capsids from AAV8 in HEK293 cells using the "triple-transfection" method at Vector Core, University of Massachusetts Medical School (Grieger 2006). Recombinant AAV8 vectors were purified by CsCl-gradient centrifugations and titered by qPCR and Digital Droplet PCR (ddPCR) using primers and probes specific to the transgenes.

The transgenic AAV vectors packaging pSS112 (FIG. 16E, FIG. 17E), pSS113 (FIG. 16F, FIG. 17F), pSS114 (FIG. 16G, FIG. 17G), and pSS115 (FIG. 16II, FIG. 17I) ("Vector A" in FIG. 10) are denoted AAV-SS112, AAV-SS113, AAV-SS1114, and AAV-SS115, respectively. Plasmid pSS112 is a proviral AAV vector encoding U6 promoter-driven gRNA 2-r251 (i.e., sg203) (comprising the targeting domain of SEQ ID NO: 1390) and EFS promoter-driven saCas9. Proviral vector pSS113 encodes U6 promoter-driven gRNA 2-r667 (i.e., sg333) (comprising the targeting domain of SEQ ID NO:1811) and EFS promoter-driven saCas9. Proviral vector pSS114 encodes U6 promoter-driven gRNA 2-r251 (i.e., sg203) (comprising the targeting domain of SEQ ID NO: 1390) and TBG promoter-driven saCas9. Proviral vector pSS114 encodes U6 promoter-driven gRNA 2-r667 (i.e., sg333) (comprising the targeting domain of SEQ ID NO:1811) and TBG promoter-driven saCas9. The components of these and other expression vectors used in the present examples are summarized in Table 11.

Transgenic mouse models of AATD have been established previously to study the pathology of the liver phenotype of AATD (Sifers 1987; Carlson 1989). A transgenic mouse model was established and proven to be a critical tool in understanding AATD liver diseases and evaluating novel therapeutics. The complete 14.4kb of hSERPINA1 locus was isolated from a PiMZ patient to generate a few transgenic lines, one of which is PiZ-11.03 (PiZ mice). This PiZ transgenic mouse model harbors 16 copies of the human SERPINA1 (hSERPINA1) transgene and recapitulates the progression and characteristics of A1AT liver diseases. High levels of circulating human AAT-Z and the abundant retention of misfolded AAT-Z proteins in hepatocytes are observed in these PiZ mice beginning at early developmental stages. Later, accumulation of AAT-Z protein stimulates ER stress and apoptosis of hepatocytes. Hepatocytes with less AAT-Z retention further increase the risk of hepatocellular carcinoma (HCC) by compensating injured cells. The PiZ transgenic mice have no lung disease phenotypes due to the intact mouse SERPINA1 loci. Therefore, the applications of the PiZ transgenic mouse model are limited to assessing only the liver abnormalities. However, the entirety of all the exons, introns, and the Z mutations in this mouse model provides the correct genetic context to evaluate gene editing approaches.

PiZ mice were bred and maintained in an AAALAC-accredited facility at Saint Louis University (SLU) School of Medicine as described in Carlson 1989. All procedures were performed in accordance with the animal protocol approved by the Institutional Animal Care and Use Committee (IA-CUC) at SLU. Mice homozygous for the human PiZ alleles were bred with C57B6 males (Jackson Laboratories) to obtain heterozygous offspring with AAT serum levels similar to that from human PiZZ patients. Studies were conducted with 6- to 16- week old heterozygous mice. Dosing groups were designed to include at least one PBS control animal in each litter of animals.

Figure 18C:
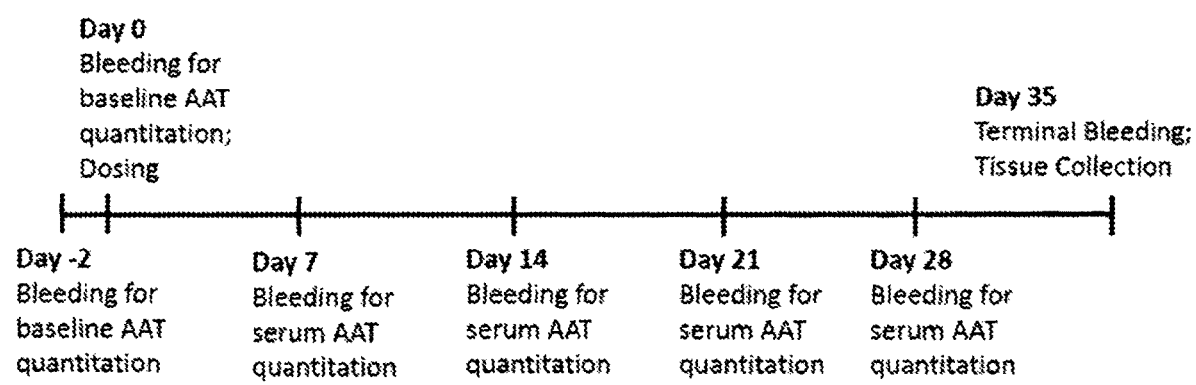

Using a surrogate AAV8-CRISPR vector targeting mouse coagulation Factor VII (mFVII), the Minimum Effective Dose (MED) of this AAV8-CRISPR vector system was determined to be 5e13 vg/kg in mice (data not shown). Mixed-gender PiZ mice at the age of 5-14 weeks old were first bled on Day –2 and 30 minutes prior to dosing to measure the baseline values of serum human AAT (hAAT) concentrations. Next, the mice were administered the PBS control or one of the four All-in-One AAV8-CRISPR vectors at a dose of 5e13 vg/kg through tail vein injections. Each group (i.e., the PBS control group and each vector group) contained 5 mice. Mice were bled weekly throughout the in-life portion of the experiments. On Day 35 post injection, animals were sacrificed and liver samples were processed for molecular biology and histology analysis (FIG. 18C). In certain embodiments, the mice may be administered PBS or $1\times10^{12}$ μg of the AAV viral vectors in 200 μL total volume via tail vein injections.

Figure 18D:
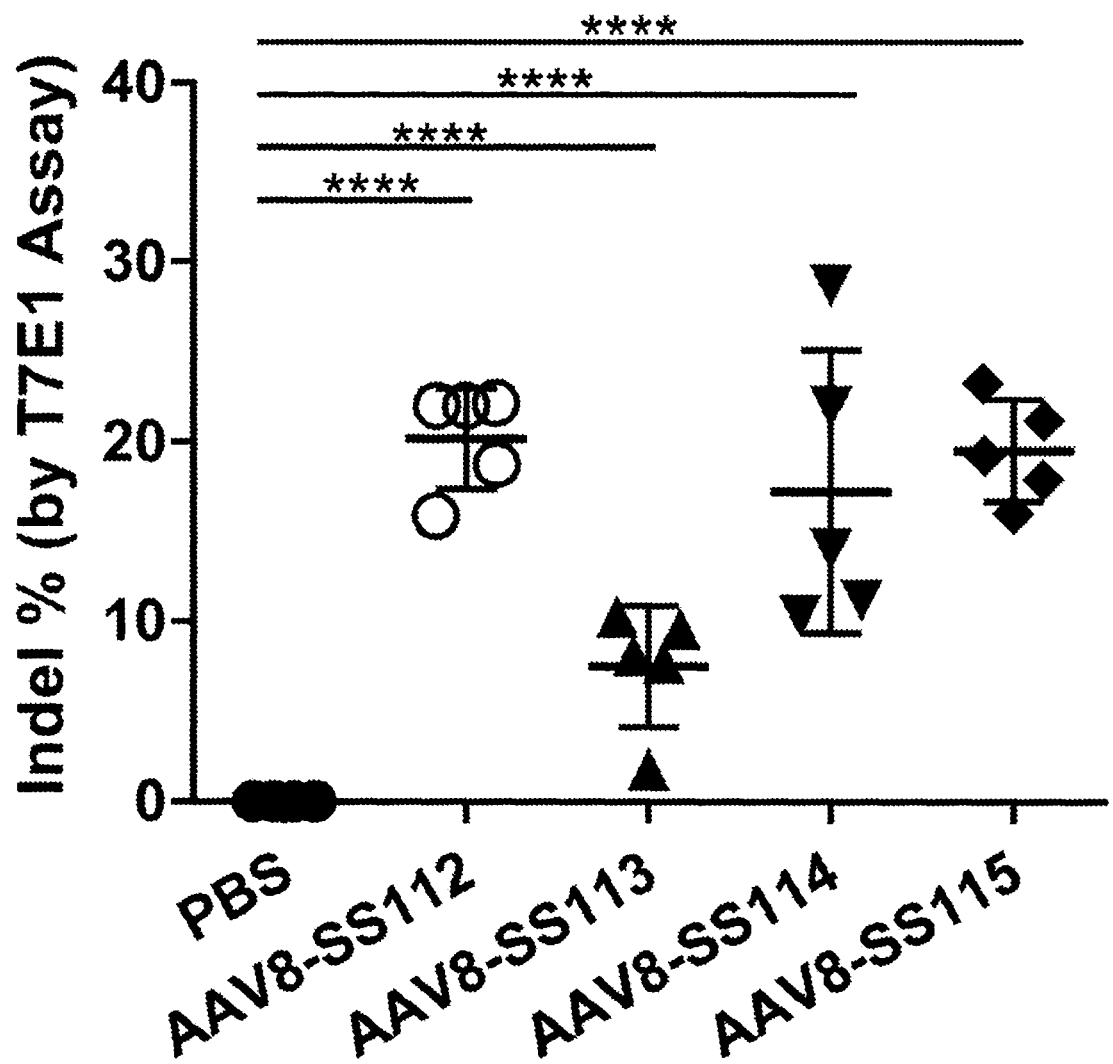

Genome modifications introduced by the All-in-One AAV8-CRISPR vectors (i.e., AAV8-SS112, AAV8-SS113, AAV8-SS114, or AAV8-SS115) were first analyzed at Day 35 post injection. Genomic DNA (gDNA) extracted from the homogenized livers dosed with PBS or one of the four AAV8 vectors were analyzed using T7 Endonuclease I (T7E1) assay (M0302, New England BioLabs)). Briefly, genomic DNA was extracted from liver pulverized by a Geno/Grinder (SPEX SamplePrep) using DNAdvance Kits (Agencourt) on a liquid-handling robot per the manufacturer's instructions. To quantify indel percentage at target genomic loci, T7E1 assays were conducted as described previously (Friedland 2015) using PCR primers OliSS76 (SEQ ID NO:2199) and OliSS82 (SEQ ID NO:2200) in Table 16. Specifically, AAV8-SS112 (sgRNA203/EFS), AAV8-SS113 (sgRNA333/EFS), AAV8-SS114 (sgRNA203/TBG), and AAV8-SS115 (sgRNA333/TBG) introduced 20%, 8%, 16%, and 20%, respectively, of indel rate at their corresponding DNA cut sites (FIG. 18D). In certain embodiments, Next Generation Sequencing (NGS) may be used to assess the specific DNA disruptions.

Figure 18E:
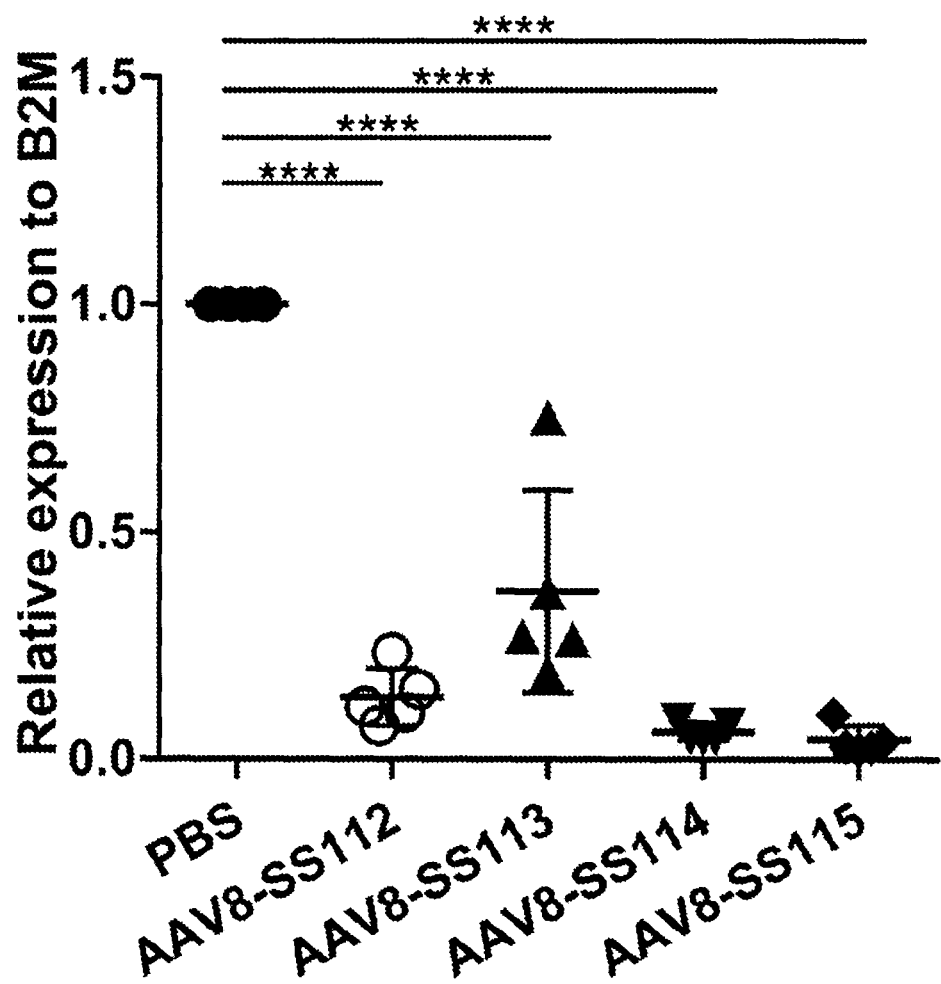

Next, the transcription levels (Cq) of hSERPINA1 in these PiZ mice were quantified using qRT-PCR amplifying the junctions between Exons III and IV of hSERPINA1 from total RNA extracted using primers oliMES103 and oliMES108 in Table 16. Briefly, total RNA was extracted from pulverized liver samples using RNeasy Mini Kits (Qiagen). RNA concentration and integrity were assayed using RNA 600 Nano Kits (Agilent) on a Bioanalyzer (Agilent) to determine an RNA Integrity Number (RIN) greater than 6.5. RNA was treated using a Turbo DNA-free Kit (Ambion) and reverse-transcribed using Superscript III RT (Invitrogen). Quantitative real-time PCR (qRT-PCR) was performed on a BioRad CFX384 with SYBR Green I Master (Roche). Cq values of hSERPINA1 were first normalized to the corresponding values of mouse beta-2-microglobulin (B2M) from each animal to obtain ΔCq using primers oliMES101 and oliMES102 in Table 16. The ΔCq value from each AAV8-CRISPR-treated mouse was then normalized to the one from the corresponding littermate treated with PBS to obtain ΔΔCq, representing changes of hSERPINA1 expression. Interestingly, a more prominent reduction of hSERPINA1 transcription measured by qRT-PCR was observed as compared to levels of gene modifications measured by T7E1 (compare FIG. 18E with FIG. 18D, respectively). Two AAV8 vectors with the TBG promoter driving saCas9 showed 94% (AAV8-SS114) and 96% (AAV8-SS115) reduction of hSERPINA1 expression compared to the PBS-treated group, while mice treated with AAV8-SS113 only showed 63% reduction, which was likely due to the combination of a less active sgRNA-303 and a less efficient EFS promoter (FIG. 18E).

The transcription results were further supported by whole-transcription RNAseq analysis on representative samples. Briefly, total RNA was extracted from pulverized liver samples using RNeasy Mini Kits (Qiagen). RNA concentration and integrity were assayed using RNA 600 Nano Kits (Agilent) on a Bioanalyzer (Agilent) to determine an RNA Integrity Number (RIN) greater than 6.5. RNA was treated Turbo DNA-free Kit (Ambion) and reverse-transcribed using Superscript III RT (Invitrogen). RNAseq library preparations and HiSeq runs were conducted at Genewiz. Ribosomal RNA depletion was performed prior to stranded RNA library preparation. Data were analyzed in-house and visualized with Integrative Genomics Viewer (The Broad Institute). By comparing the total reads mapped to the hSERPINA1 transcript, the animals treated with vectors with the TBG promoter showed 90% reduction of expression (data not shown). The mouse treated with AAV8-SS113 demonstrated 58% knock-down of hSERPINA1 transcription compared to the mouse dosed with PBS (data not shown). In conclusion, the efficacy of these four AAV8-CRISPR vectors in knocking down hSERPINA1 transcription in adult PiZ mice ranks AAV8-SS115 (sgRNA-333/TBG)≈AAV8-SS114 (sgRNA-203/TBG)>AAV8-SS112 (sgRNA-203/EFS)>AAV8-SS113 (sgRNA-333/EFS).

Figure 18F:
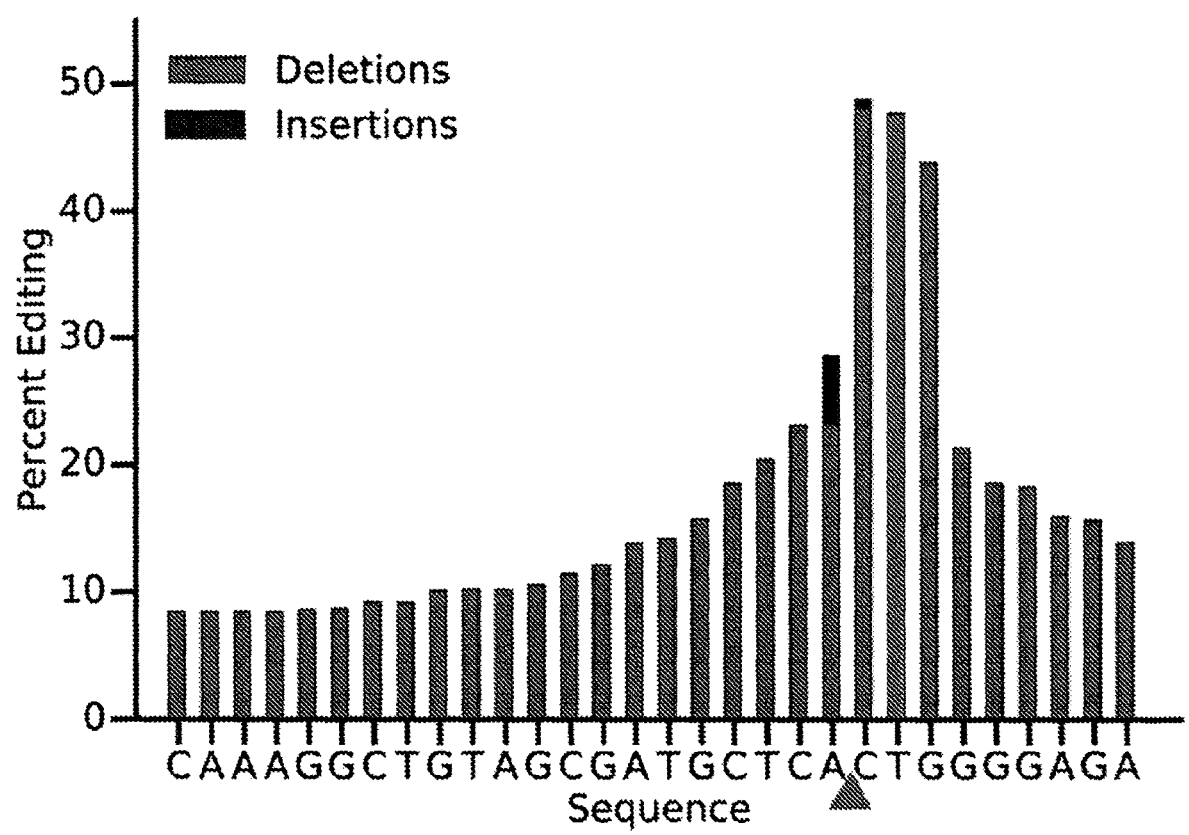

Deep sequencing results of the remaining transcripts revealed high levels of nucleotide substitutions and/or indels near the cut site. For instance, in one animal treated with AAV8-SS1115, there were 50% gene modifications on Exon II in the remaining 7% of transcripts (FIG. 18F). These molecular analyses suggest that AAV8-CRISPR targeting the early exon of hSERPINA1 knocks down AAT-Z protein expression by disrupting the coding sequences and, potentially, inhibiting gene transcription.

AA V8-CRISPR Treatment Reduces AAT-Z Proteins in Circulation and in Hepatocytes of Transgenic Mice Next, the phenotypic changes in the PiZ mice transduced by AAV8-CRISPR vectors targeting Exon II of hSERPINA1 were analyzed. The majority of AAT proteins are synthesized in rER of hepatocytes and secreted to the blood circulation to function as a protectant of the lung epithelium. AAT proteins with the Z mutation (AAT-Z) form aggregates in hepatocytes and, therefore, are unable to be released to the blood stream.

Here, the concentration of human AAT in the circulation of the PiZ mice was measured as a biomarker of gene disruption in the liver. An ELISA assay with a human-specific AAT antibody was performed to minimize the background interference of mouse AAT in the PiZ mice. Briefly, blood samples were collected by tail nicking at interval time points and by cardiac puncture at terminal time points. Blood was further processed into serum and kept frozen in −80'C. Human AAT ELISA Kit (ab108799, Abcam) was used to measure the absolute concentrations of human AAT in serum samples from the PiZ transgenic mice. Serum samples were thawed on ice and diluted in a supplied assay buffer containing 0.01% naïve C57BL/6 mouse serum. A standard curve was prepared by reconstituting the supplied recombinant AAT as per the supplied protocol to 100 ng/ml and serial dilutions to 0.137 ng/ml. After antibody incubation and exposure steps, the plate was read on an Envision (Perkin Elmer, Santa Clara, Calif.) at the absorbance of 450 nm. A standard curve was calculated and fitted to a 4-parameter sigmoidal curve (Graph Pad Prism, La Jolla Calif.) using the background corrected Absorbance values for each standard. For each serum sample, the dilution(s) lying in the linear range of the standard curve were extrapolated to generate raw values. The raw values were adjusted by multiplying by the dilution to give the actual value in serum in ng/ml. If there were two values in the linear range, both values were calculated and then averaged.

During the course of the in-life portion of the studies, mice were bled at Days −2, 0, 7, 14, 21, 28, and 35 post injections. The day of injections counts as Day 0. Starting from Day 7, a significant reduction of circulating AAT was observed in mice dosed with AAV8-SS14 and AAV8-SS115, and then a plateau was observed around Day 14 (FIG. 19A). At the terminal bleeding on Day 35, mice treated with AAV8-SS115 (sgRNA-333 & TBG promoter) showed more than two-log of AAT reduction. In contrast, circulating AAT concentrations in the AAV8-SS113 (sgRNA-333 & EFS promoter) group were reduced by only 44% compared to the corresponding values from the same animals on Day 0.

A histology analysis was conducted next to investigate the effect of gene disruption on AAT-Z retention in the hepatocytes of PiZ mice. AAT proteins are highly glycosylated and therefore can be visualized using Periodic Acid-Schiff Staining after Diastase Treatment (PAS-D) staining that reacts with the hydroxyl groups on glycans. Briefly, liver tissues were collected, fixed in 10% buffered formalin, embedded in paraffin, and sectioned into 5 um slices. Sections were stained with PAS-D to visualize AAT aggregation in hepatocytes, followed by quantitation of globule counts and total globule area using ImageJ (Rasband W. S., National Institutes of Health, USA). Three random areas were imaged and analyzed for each liver sample. Slides of (Haemotoxylin and Eosin) H&E staining were also imaged to visualize general morphology and AAT aggregates.

Positive PAS-D staining in PBS-treated mice were identified as punctuated purple (dark grey in figures) dots under white-field microscope (FIGS. 19B and 22). In PiZ transgenic mice, AAT globules form in the livers after birth and grow over time. By 4 weeks of age, clusters of hepatocytes could be detected by PAS-D staining. In the adult mice that were treated, the terminal collection happens around age of 10-19 weeks. Compared to the PBS group, the treatment groups showed dramatic changes in the total number and size of AAT globules as analyzed by ImageJ (FIGS. 19C & 19D). To support this observation, the soluble and insoluble fractions of the homogenized PiZ livers were separated to differentiate secreted and aggregated forms of AAT-Z (FIG. 19E). Proteins were analyzed by Western blotting with a human AAT specific antibody. Briefly, soluble and insoluble fractions of AAT were isolated as previously described (An 2005). In short, liver tissues were homogenized with a chilled Dounce homogenizer and sheared by passing through a 28-gauge needle. Total protein content was determined to aliquot 5 µg of total liver lysate from each sample. After centrifugation at 10,000 g for 30 minutes at 4'C$_1$ supernatant was immediately separated from the insoluble layer with care. Both fractions were re-suspended and denatured prior to being loaded on SDS-PAGE gels. Human AAT protein was probed using a Goat Anti-human Alpha-1 anti-trypsin antibody (cat #80502, DiaSorin, Saluggia, Italy) and a HRP conjugated Rabbit anti-Goat IgG antibody (cat #P0449, Agilent, Santa Clara, Calif.). Mouse GAPDH was probed as loading control. Scanned blots were analyzed using ImageJ (Rasband W. S., National Institutes of Health, USA).

Figure 19F:
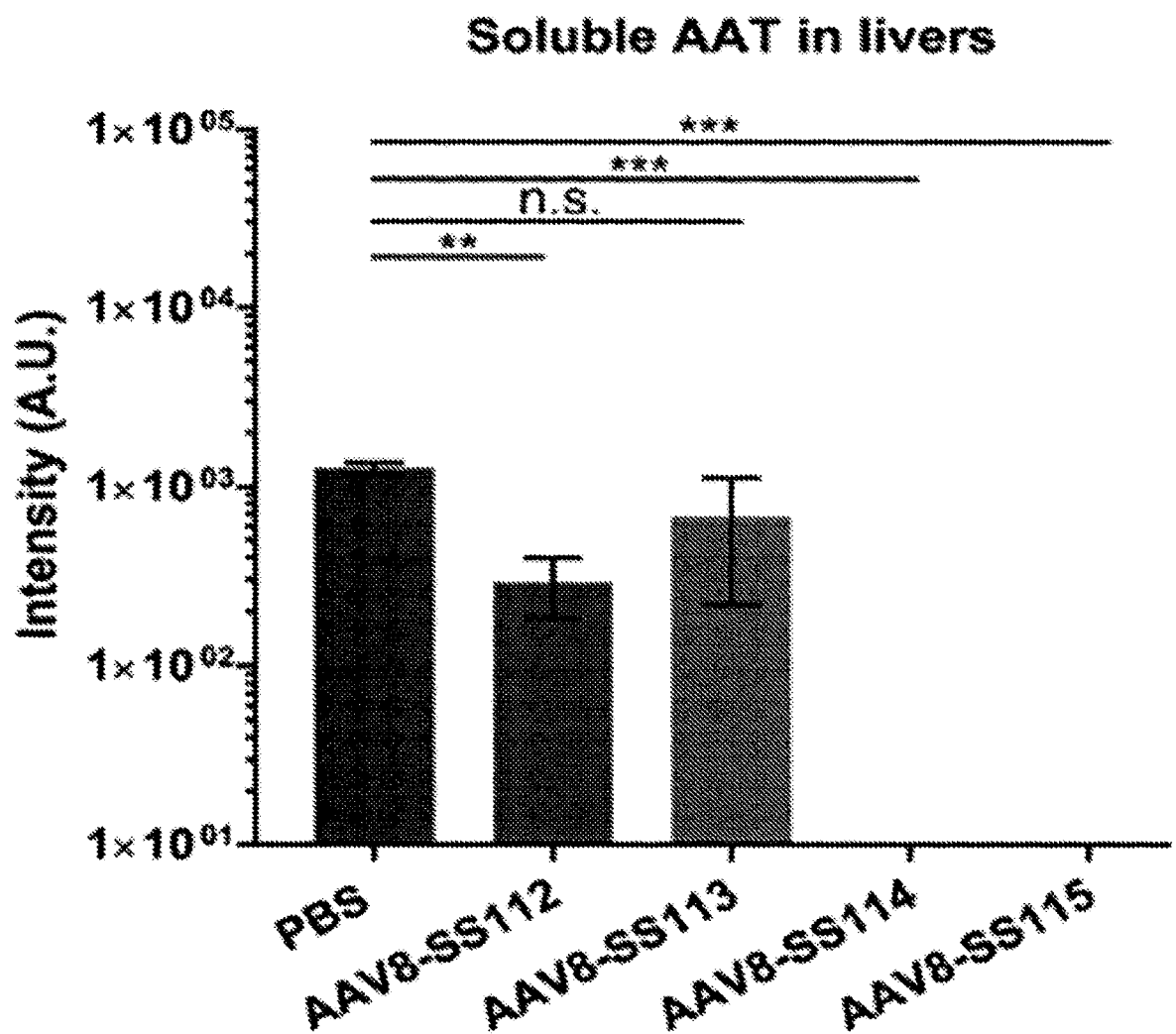
Figure 19G:
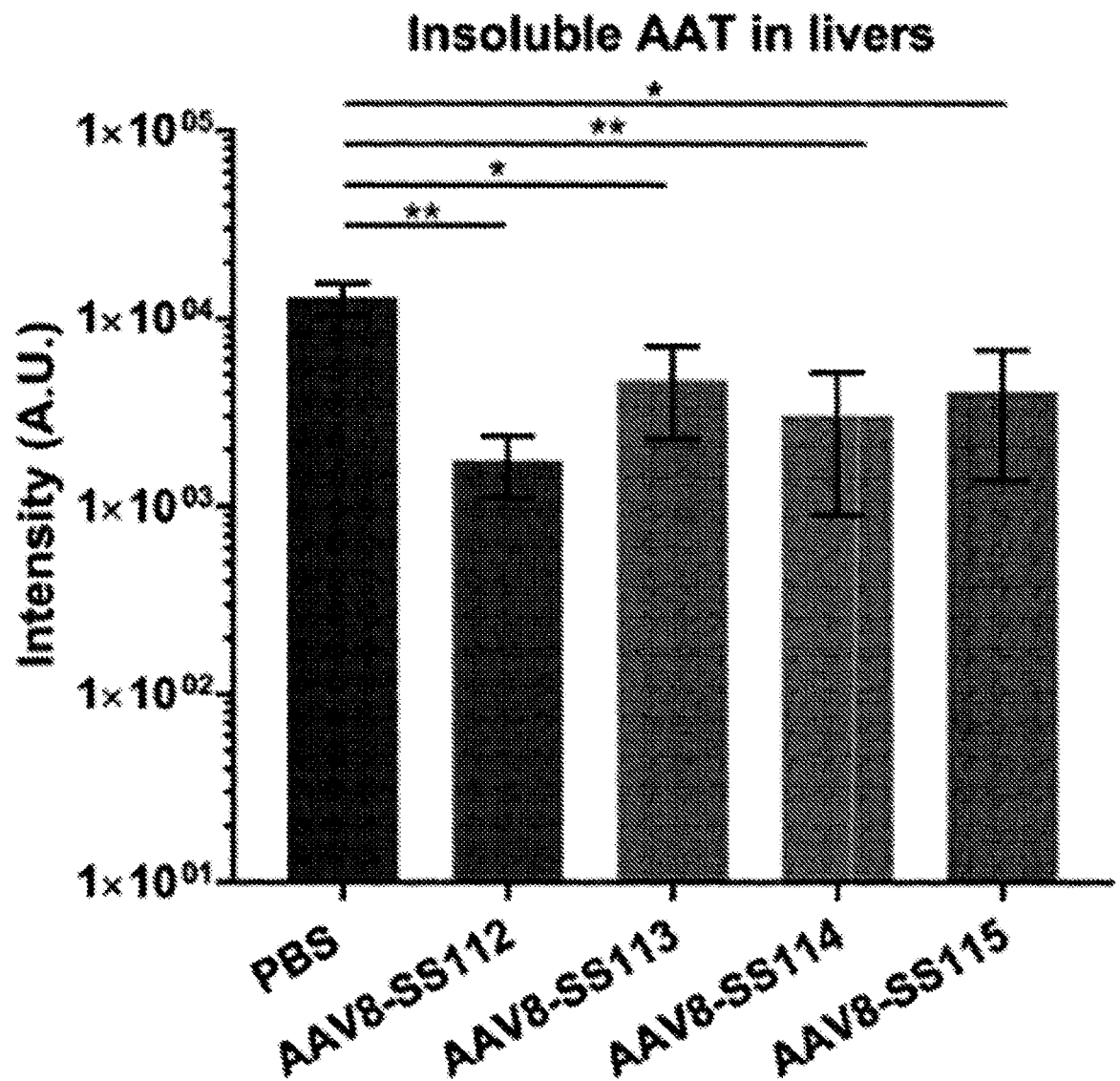

As measured by Western blotting, AAV8-CRISPR treatment with TBG promoter-driving saCas9 completely abrogated the soluble AAT in liver lysates (FIG. 19F). In the same mice, AAT contents in the insoluble fractions were also reduced by 77% compared to the PBS group (FIG. 19G). In addition, no dramatic changes were observed in hepatocyte morphology, aspartate aminotransferase (ALT), or circulating albumin levels after AAV8-CRISPR treatment, indicating minimal liver toxicity (FIGS. 23A-C). These results suggest that the CRISPR/Cas9 system delivered by AAV8 vectors elicits prolonged hSERPINA1 inhibition in PiZ mice that significantly reduces the AAT contents in both circulation and hepatocytes. This study demonstrates the efficiency of sgRNA 2-r251 (sg203) and sgRNA 2-r667 (sg333) (comprising the targeting domains of SEQ ID NOs:1390 and 1811, respectively) in knocking out hSERPINA1-PiZ expression in vivo, and compares the EFS and TBG promoters in driving saCas9 expression in murine liver tissues.

In this example, two-tailed Student t tests and one-way ANOVA with Bonferroni multiple comparison post-test were performed using Excel and GraphPad Prism 7 (GraphPad, San Diego, Calif.). Statistical significance was assumed with a p-value <0.05 (*), <0.01 (), and <0.001 (*). Error bars shown in the figures represent s.e.m. unless noted otherwise.

In certain embodiments, a PiZ transgenic mice may be generated as follows: PiZ alleles of hSERPINA1, including the 2 kb flanking sequences, may be cloned from a PiMZ heterozygous individual and microinjected into C57B1/6 mouse embryos. In these embodiments, one of the transgenic mouse strains harboring multiple copies of the PiZ transgene recapitulates the liver pathology of A1AT deficiency in patients. This mouse model has been previously analyzed to shed light on the formation of intrahepatocytic globules, inflammations, cell regeneration, hyperplasia, and tumorigenesis due to PiZ-A1AT aggregation (An 2005; Lindblad 2007).

Example 3: Construction and Evaluation of AAV Vector to Express A1AT (Approach 2B)

Vector Construction

The coding sequence (CDS) of hSERPINA1 was extracted from USCS Genome Browser and synthesized. This coding sequence, together with Kozak sequence, was subcloned into pAF003 to replace the coding sequence between the CMV promoter and the bovine growth hormone polyadenylation signal (bGH polyA) to generate an expression vector dubbed pSS111 (Table 11; FIG. 16D, FIG. 17D).

Figure 10:
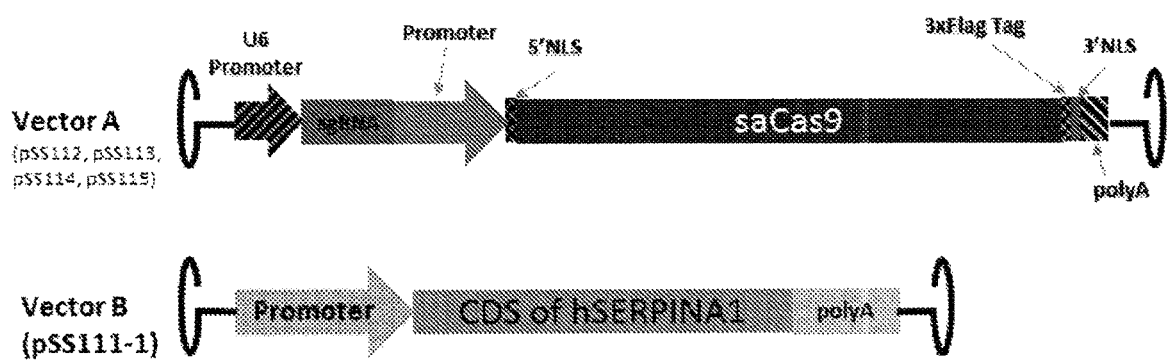
FIG. 10 provides schematic representations of vectors for use in methods of Approach 2A and 2B.

The CMV-A1AT-bGHpolyA moiety on pSS111 was subcloned between two AAV2 ITRs to generate an AAV proviral vector encoding A1AT, pSS111-1 (FIG. 16C, FIG. 17C) ("Vector B" in FIG. 10). Using restriction cloning, the promoter driving expression of A1AT may be readily switched to constitutive promoters or tissue-specific promoters, including for example TBG promoter, hA1AT promoter, or ApoE enhancer followed by hA1AT promoter. These AAV proviral vectors may be packaged into AAV serotypes and administered in animal models of A1AT deficiency to evaluate the gene augmentation activity in the aforementioned gene editing approach.

Evaluation of A1AT Expression

Figure 11A:
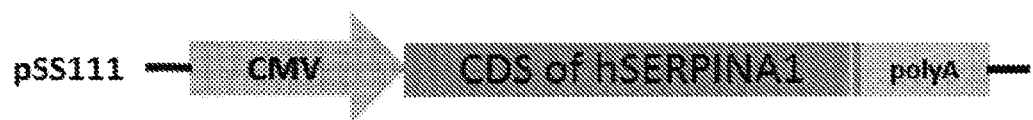
FIG. 11A provides a schematic representation of vector pSS111 for use in Approach 2B.
Figure 11B:
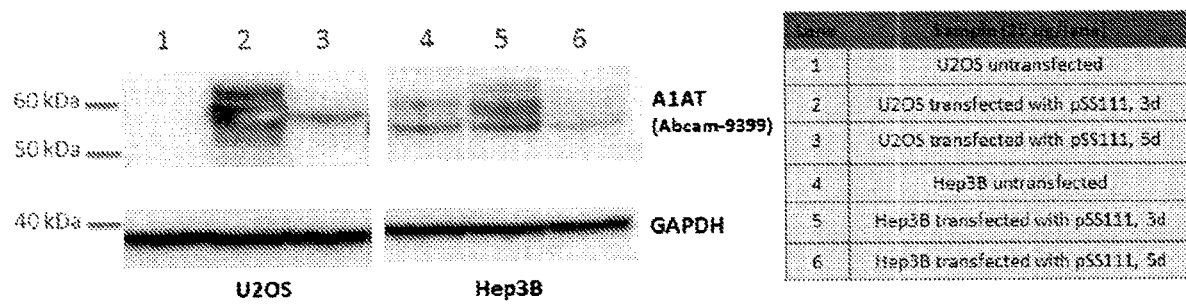
FIG. 11B shows results for hSERPINA1 gene augmentation.

U2OS and Hep3B cell lines were transfected with pSS111 to assess vector functionality in terms of A1AT expression. The SERPINA1 locus has been shown to transcribe actively in cell lines originated from liver, including Hep3B, but not in U2OS, an osteosarcoma cell line (Barretina 2012). Vector pSS111 was nucleofected into either U2OS cells with the SE kit and program DN-100, or Hep3B cells with the SE kit and program 96-FF-120. At 3 days and 5 days post transfection, the bulk population of transfected cells were lysed with RIPA buffer to extract cytoplasmic proteins. 80 µl of total protein lysates were loaded in each lane on a 4-12% Tris-Bis PAGE gel. Post electrophoresis and transfer, the blots were blocked and incubated with a mouse monoclonal antibody recognizing human A1AT (Abcam-9399) followed by a secondary antibody, HRP-conjugated goat anti-mouse IgG (Santa Cruz Biotechnology, sc-2005), to visualize A1AT expression. GAPDH bands were probed by a rabbit monoclonal antibody (Cell Signaling Technologies, CST-14C10) followed by HRP-conjugated donkey anti-goat IgG. As shown in FIG. 11, endogenous and ectopic expression of A1AT was observed in both U2OS (lanes 1-3) and Hep3B (lanes 4-6) cells at 3 days (lanes 2 & 5) and 5 days (lanes 3 & 6) post nucleofection.

Example 4: In Vivo Assessment of the Therapeutic Effects of Simultaneous Knockout of PiZ Alleles and Augmentation of A1AT Expression (Approach 2B)

To test the combination of gene knockout and gene augmentation, the most potent All-in-One AAV vectors from Example 2 (i.e., AAV-SS112, AAV-SS113, AAV-SS114, and/or AAV-SS115) are co-administered with AAV vectors from Example 3 packaging pSS111-1. $1 \times 10^{11}$ µg of AAV-SS111-1 and $1 \times 10^{11}$ µg of All-in-One AAV vector are administered into PiZ transgenic mice via tail vein injections. Tissues are collected at 14, 28, and 56 days post injection and analyzed for gene modification, A1AT aggregation in hepatocytes, hSERPINA1 expression in liver and serum, and biodistribution of saCas9 protein. Results from this experiment support the use of CRISPR/Cas9-mediated gene knockout in combination with hSERPINA1 gene augmentation to treat A1AT deficiency in PiZZ homozygous patients.

Figure 12:
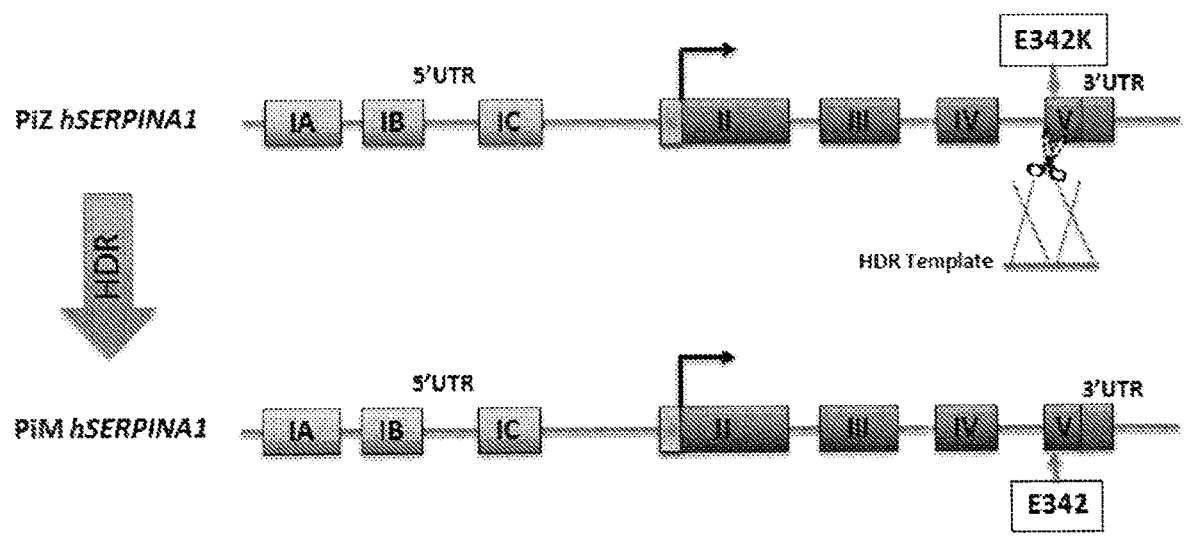
FIG. 12 illustrates the HDR-based SERPINA1 editing strategy of Approach 1A.
Figure 13:
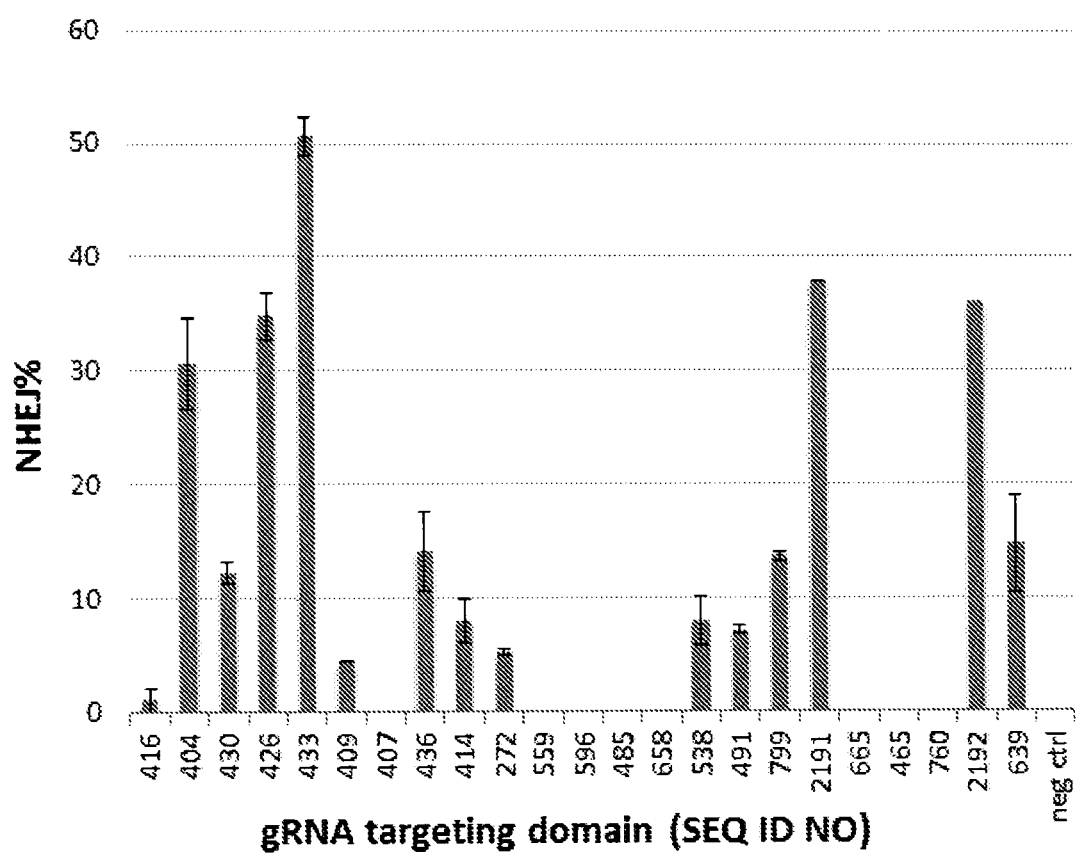
FIG. 13 shows gRNA screening results on Exon V in Hep3B cells.

Example 5: Design and Screening of gRNAs Targeting Exon V of hSERPINA1 (Approach 1A)

gRNAs were designed to target the region spanning from 200 bp upstream to 200 bp downstream of the Z mutation (E342K) on Exon V to introduce DNA disruption near E342K on PiZ alleles (FIG. 12). gRNA candidates were identified using a custom bioinformatics tool for guide RNA design. 250 ng of each STITCHR fragment encoding a U6-driven sgRNA and 750 ng of pAF003 were nucleofected into 100,000 Hep3B cells with the SE kit and program 96-FF-120 on a Lonza™ 96-well shuttle system. Three days post nucleofection, gDNAs were extracted, followed by PCR amplification of the region flanking E342 on Exon V. T7E1 endonuclease assay was used to compare the indel rates induced by individual gRNA sequences as shown in FIG. 13. Among the 23 gRNAs tested (see Table 12), the highest % NHEJ was observed with the gRNAs SERPINA1-1A-r181, SERPINA1-1889, SERPINA1-1970, SERPINA1-1A-r174, and SERPINA1-1A-r152 (comprising the targeting domains of SEQ ID NOs:433, 2191, 2192, 426, and 404, respectively).

Example 6: Design and Optimization of ssODN Donors for In Vitro HDR at the Point Mutation in hSERPINA1 (Nucleotide c.1024G>A) Encoding the Z-Mutation E342 (Approach 1A)

gRNA 1889 (sgRNA1889) (comprising the targeting domain of SEQ ID NO:2191) demonstrated a 37.8% indel rate in Hep3B cells in Example 5. The hSERPINA1 target domain complementary to sgRNA1889 includes the nucleotide c.1024, the mutation of which from G>A results in the Z mutation (E342K). The targeting domain sequence of sgRNA1889 (SEQ ID NO:2191, Table 12) is complementary to the hSERPINA1 wild-type M allele in Hep3B cells (see nucleotides 13978 to 13999 in SEQ ID NO:2231). The corresponding sgRNA for targeting PiZ alleles, SERPINA1-1A-r454 (sgRNA1889Z; SEQ ID NO:706), is complementary to the Z allele, i.e., nucleotides 13978 to 13999 in SEQ ID NO:2231 with the Z mutation c.1024G>A mutation (bold and underscored) (Table 12). The close proximity (4 bp) between the DNA double-strand break induced by sgRNA1889 and the Z mutation suggested that sgRNA1889 could be used to evaluate HDR that can be used to alter the Z mutation to the wild-type M allele.

The goal in this example was to improve the rate of HDR near the nuclease cut sites (breaks) to correct the A>G nucleotide mutation in the SERPINA1 gene causing the E342K amino acid change in PiZ patients by using single-stranded oligodeoxynucleotides (ssODN) paired with double-stranded DNA breaks and homology templates. When used in combination with non-viral delivery modalities, ssODN can be efficiently delivered to hepatocytes. Therefore, this HDR approach bears significant therapeutic potential.

Due to the lack of a cellular system harboring the Z-mutation, wild-type Hep3B cells were used as a proof-of-concept model to optimize the configurations of ssODN. All of the ssODN constructs used were designed to introduce the Z-mutation as a readout to assess the ability of the ssODNs to improve HDR frequencies. Upon optimization, the best ssODN configuration can be altered to correct the Z mutation in transgenic mouse models and patients, instead of introducing the Z mutation.

Determination of gene targeting frequency involves measuring the percentage of alleles that have undergone homologous directed repair (HDR) with the exogenously provided donor template or endogenous genomic donor sequence and which therefore have incorporated the desired correction. If the desired HDR event creates or destroys a restriction enzyme site, the frequency of gene targeting may be determined by a RFLP assay. If no restriction site is created or destroyed, sequencing may be used to determine gene targeting frequency. If a RFLP assay is used, sequencing may still be used to verify the desired HDR event and ensure that no other mutations are present. If an exogenously provided donor template is employed, at least one of the primers is placed in the endogenous gene sequence outside of the region included in the homology arms, which prevents amplification of donor template still present in the cells. Therefore, the length of the homology arms present in the donor template may affect the length of the PCR amplicon. PCR amplicons can either span the entire donor region (both primers placed outside the homology arms) or they can span only part of the donor region and a single junction between donor and endogenous DNA (one internal and one external primer). If the amplicons span less than the entire donor region, two different PCRs should be used to amplify and sequence both the 5' and the 3' junction. If the PCR amplicon is short (less than 600 bp) it is possible to use next generation sequencing. Following PCR, Next Generation Sequencing (NGS) adapters and barcodes (for example Illumina multiplex adapters and indexes) may be added to the ends of the amplicon, e.g., for use in high throughput sequencing (for example on an Illumina MiSeq). This method allows for detection of very low gene targeting rates. If the PCR amplicon is too long for NGS, Sanger sequencing can be performed. For Sanger sequencing, purified PCR amplicons will be cloned into a plasmid backbone (for example, TOPO cloned using the LifeTech Zero Blunt® TOPO® cloning kit), transformed, miniprepped, and sequenced. The same or similar assays described above can be used to measure the percentage of alleles that have undergone HDR with endogenous genomic donor sequence and which therefore have incorporated the desired correction.

To evaluate in vitro HDR efficiency at the nucleotide sequence encoding amino acid E342 of hSERPINA1 in Hep3B cells, four ssODNs having different configurations were designed and synthesized (Table 13). ssODN_1, ssODN_2, and ssODN_3 contain sequences from the transcription strand of the hSERPINA1 locus, and ssODN_4 contains sequences from the non-transcription strand (FIG. 25). As listed in Table 13, each ssODN presents a different level of asymmetry relative to the double-stranded break formed by saCas9 and sgRNA-1889 (FIG. 25). There are four sets of single nucleotide polymorphisms (SNPs) resulting in 10 mutations that are introduced by each ssODN donor. The first set of SNPs introduce the Z-mutation (GAG>AAA as shown in the bold and shaded sequence in Table 13). The second set of SNPs introduce an MfeI restriction site on the target sequence to quantify HDR efficiency using a restriction fragment length polymorphism (RFLP) assay, which also disrupts the recognition of the PAM sequence of sgRNA1889 and the genomic DNA post HDR events (underscored and lowercase letters in Table 13). The third set of SNPs disrupt the recognition of the PAM sequence of sgRNA1889 and the genomic DNA post HDR events (bold and italicized nucleotides in Table 13). The fourth set of SNPs prevent sgRNA re-recognition and Cas9 re-cutting post HDR events (underscored nucleotides in Table 13).

In ssODN_1, the 5' and 3' homology arms are 88 nt and 77 nt in length, respectively, from the double-stranded DNA break induced by sgRNA1889. In ssODN_2, the 5' and 3' homology arms are 99 nt and 66 nt in length, respectively, from the Cas9 cut site (break). The length for the 5' and 3' homology arms from the Cas9 break in ssODN_3 are 66 nt and 99 nt, respectively. ssODN_4 is the reverse complement of ssODN1.

ssODN_1 was co-transfected with a STITCHR fragment encoding sgRNA1889 (comprising the targeting domain of SEQ ID NO:2191) and plasmid pSS79 encoding a codon-optimized saCas9 with an N-terminal NLS, a C-terminal NLS, and a C-terminal triple Flag tag (FIG. 16L, FIG. 17L) in Hep3B cells to mutate the E342 coding sequence in the hSERPINA1 loci (i.e., resulting in the mutation G>A at nucleotide c.1024 (the Z mutation)). Briefly, 750 ng of pSS79, 250 ng of STITCHR fragment, and 25 pmol of ssODN_1 were nucleofected in 100,000 Hep3B cells with a 96-well Nucleofector Kit SE and program 96-FF-120. Five days post transfection, transfected cells were collected and gDNAs were extracted to amplify a 1 kb region flanking the nucleotide sequence that encodes the amino acid E342. Gene editing events introduced by saCas9 and HDR were quantified by T7E1 endonuclease assay. The total frequency of gene modification was found to be 62.0% (Table 14). Using the MfeI site on the HDR donor sequence, RFLP analysis determined the total HDR frequency to be 17.1%. In order to categorize the specific gene editing events, this 1kb amplicon from the modified Hep3B cells also underwent TOPO cloning followed by Sanger sequencing, and NextGen Sequencing with MiSeq. As shown in Table 14, 32.0% of alleles underwent HDR events that introduced all 10 mutations present in the ssODN_1, while 59.7% of the editing events were NHEJ-type and 8.3% of the alleles remained unmodified.

Figure 14A:
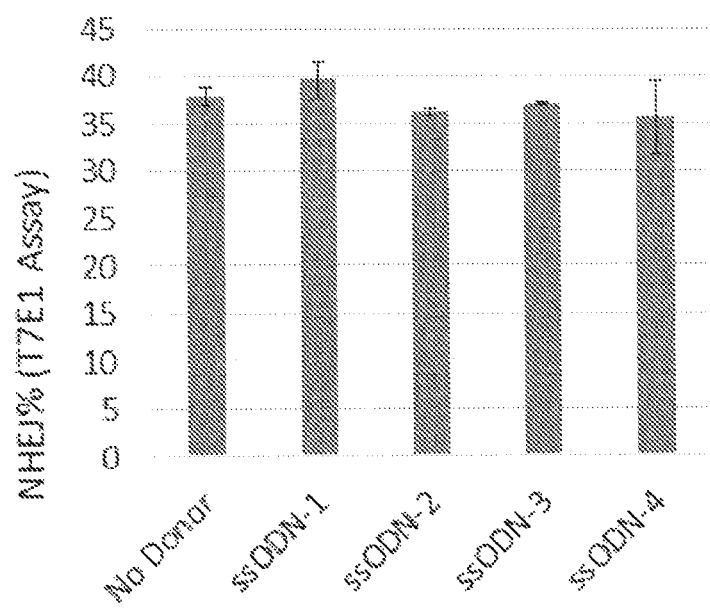
FIGS. 14A and 14B show a comparison of various ssODN's in mediating HDR.
Figure 14B:
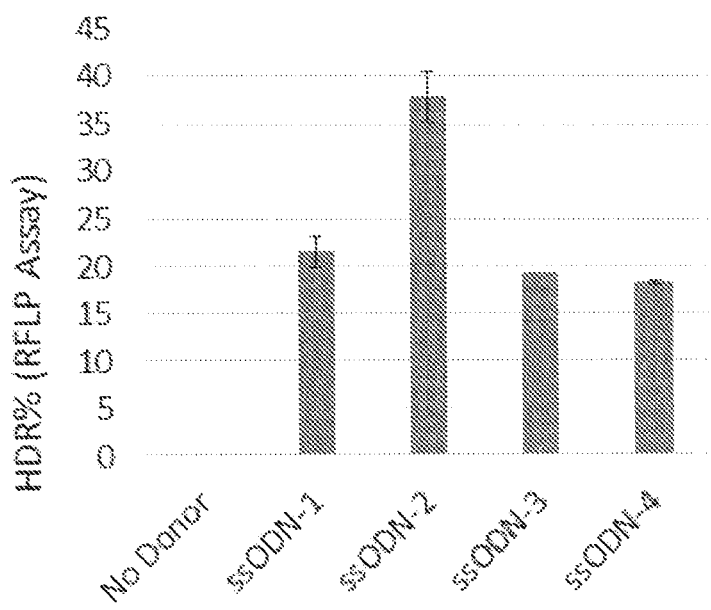

In order to assess the HDR events mediated by different configurations of ssODN donors in vitro, Hep3B cells were nucleofected with a Nucleofector Kit SE and program 96-FF-120 on a Lonza™ 96-well shuttle system. Each triple transfection of 100,000 Hep3B cells includes 750 ng of pSS79 encoding a codon-optimized saCas9 driven by a CMV promoter (see Table 11), 250 ng of STITCHR fragment encoding a U6-driven sgRNA1889, and 25 pmol of ssODN oligo. Five days post nucleofection, cells were lysed to extract gDNA, and a region flanking the target sequence of sgRNA1889 was amplified by PCR. Total gene modification mediated by NHEJ and HDR was assessed by T7E1 endonuclease assay. In addition, RFLP assays were carried out with MfeI-HF as described above to quantify the HDR frequencies. As shown in FIG. 14A, the frequencies of total gene modifications as measured by T7E1 assays were not significantly different. However, the HDR frequency mediated by ssODN_2 (37.76% in RFLP assay with MfeI-HF) was significantly higher than those mediated by other ssODN donors (FIG. 14B).

The PCR amplicons from hSERPINA1-ExonV were cloned into a TOPO vector backbone using the Zero-Blunt TOPO cloning kit (Life Technologies) and transformed into chemically competent TOP10 cells according to the product manual. Each bacterial colony representing one sequence variant was isolated and sequenced. The pooled sequences were analyzed for their specific gene modification events. As shown in Table 15, Hep3B cells co-transfected with pSS79, STITCHR sgRNA1889, and ssODN_2 demonstrated 50.0% HDR events, while the frequency with ssODN_1 was 25.0%. NHEJ-type DNA repair events induced by CRISPR/Cas9 were 50.0% with ssODN_2 and 75.0% with ssODN_1.

These results show that a 5'-extended ssODN donor (relative to the gRNA cleavage site) induces higher HDR frequencies compared to a 3'-extended donor template or a 'balanced' HDR donor with similar length of 5' and 3' homology arms relative to the Cas9 break on the hSERPINA1 locus in Hep3B cells. In addition, donors designed to anneal to either strand of DNA do not demonstrate significant differences in mediating HDR events on the hSERPINA1 locus in Hep3B cells.

To assess in vitro HDR events mediated by other configurations of ssODN donors, three additional ssODN donors, ssODN_5, and ssODN_6, ssODN_7, were developed that contain sequences from the non-transcription strand (FIG. 25). ssODN_5, and ssODN_6, and ssODN_7 present a different level of asymmetry near the double-stranded break by saCas9 and sgRNA-1889 (Table 13, FIG. 25). Similar to the other four ssODNs, each ssODN includes four sets of single nucleotide polymorphisms (SNPs), resulting in 10 mutations, as shown in Table 13.

Briefly, 100,000 Hep3B cells were nucleofected with 750 ng of plasmid pSS79 expressing saCas9, 250 ng of PCR fragment containing U6 promoter driving sgRNA-1889 (comprising the targeting domain of SEQ ID NO:2191), and 2.5 pmol of ssODN (i.e., ssODN_1, ssODN_2, ssODN_2, ssODN_3, ssODN_4, ssODN_5, ssODN_6, or ssODN_7), using SE nucleofection solution and program 96-FF-120. Three days post transfection, genomic DNA samples were collected from these cells and were subjected to Next-Gen Sequencing (NGS) to quantify the total indel rate and the HDR rate near the cut site (break) of sgRNA-1889 on Exon V of hSERPINA1 in Hep3B cells. As shown in FIG. 26, ssODN_1 yielded 50.35% of total indel rate on hSER-PINA1-ExonV, while ssODN_7 led to 82.61% indel rate with the same cut site (break). In terms of HDR frequencies, ssODN_1 (the sequence from the transcription strand and symmetrical relative to the break) resulted in 41.53% on Exon V. Intriguingly, ssODN_2 (the sequence from the transcription strand and 60%:40% imbalanced on the 5'-end of the break) showed the highest HDR rate of 44.80% near the break of sgRNA-1889, as quantified by NGS analysis. In contrast, ssODN_3 with a 40%:60% imbalanced sequence relative to the break showed 33.49% HDR correction. All four of the ssODNs with sequences from the non-transcription strand (i.e., ssODN_4, ssODN_5, ssODN_6, ssODN_7) yielded HDR frequencies less than 31%.

In sum, ssODNs with the sequence from the transcription strand and a 50%:50% or 60%:40% 5' homology arm-to-3' homology arm asymmetry relative to the DNA double-stranded break led to the highest HDR rate near the nuclease cut site (break). In the context of the wild-type hSEPRINA1 sequence, ssODN_1 and ssODN_2 were the optimal configurations to introduce point mutations to alter the E342 amino acid on hSERPINA1 protein.

In the context of PiZ patients or transgenic mouse models, ssODN_1_Z mutation or ssODN_2_Z mutation (Table 13) may be used with saCas9 (recognizing PAM:CTGAAG) and sgRNA1889Z (comprising the targeting domain of SEQ ID NO:706) to target the Z mutation to achieve a high rate of HDR correction of the mutation K342 back to wildtype E342, therefore curing the Z-mutation.

In conclusion, CRISPR/Cas9 targeting the Z mutation can be combined with ssODN to correct the Z mutation in AATD patients as human therapeutics. In certain embodiments, the optimal configuration of the candidate ssODN molecules may include, but are not limited to, (1) sequences from the transcription strand of the genetic locus, and (2) close to 50%-50% and 60%-40% asymmetry of the 5'-homology arm-to-3' homology arm asymmetry relative to the DNA double-stranded break. In certain embodiments, the therapeutics may be composed of without limitation, (1) viral delivery of Cas9 coding sequences, viral delivery of gRNA sequence, non-viral delivery of ssODN, (2) viral delivery of Cas9 coding sequences, non-viral delivery of gRNA sequence, non-viral delivery of ssODN, (3) non-viral delivery of Cas9 DNA or mRNA, viral delivery of gRNA sequence, non-viral delivery of ssODN, or (4) non-viral delivery of Cas9-gRNA RNP complexes, and non-viral delivery of ssODN.

Example 7: Design of AAV Vectors for Delivering HDR Templates (Approach 1A)

AAV has been previously demonstrated to promote HDR ex vivo and in vivo in the presence of endonuclease-induced dsDNA breaks (Sharma 2015; Wang 2015a; Wang 2015b). The mechanism of AAV-mediated HDR was suggested to involve the single-stranded nature of the AAV genome and protection of HDR templates by the hairpin structures of the ITRs.

Figure 15:
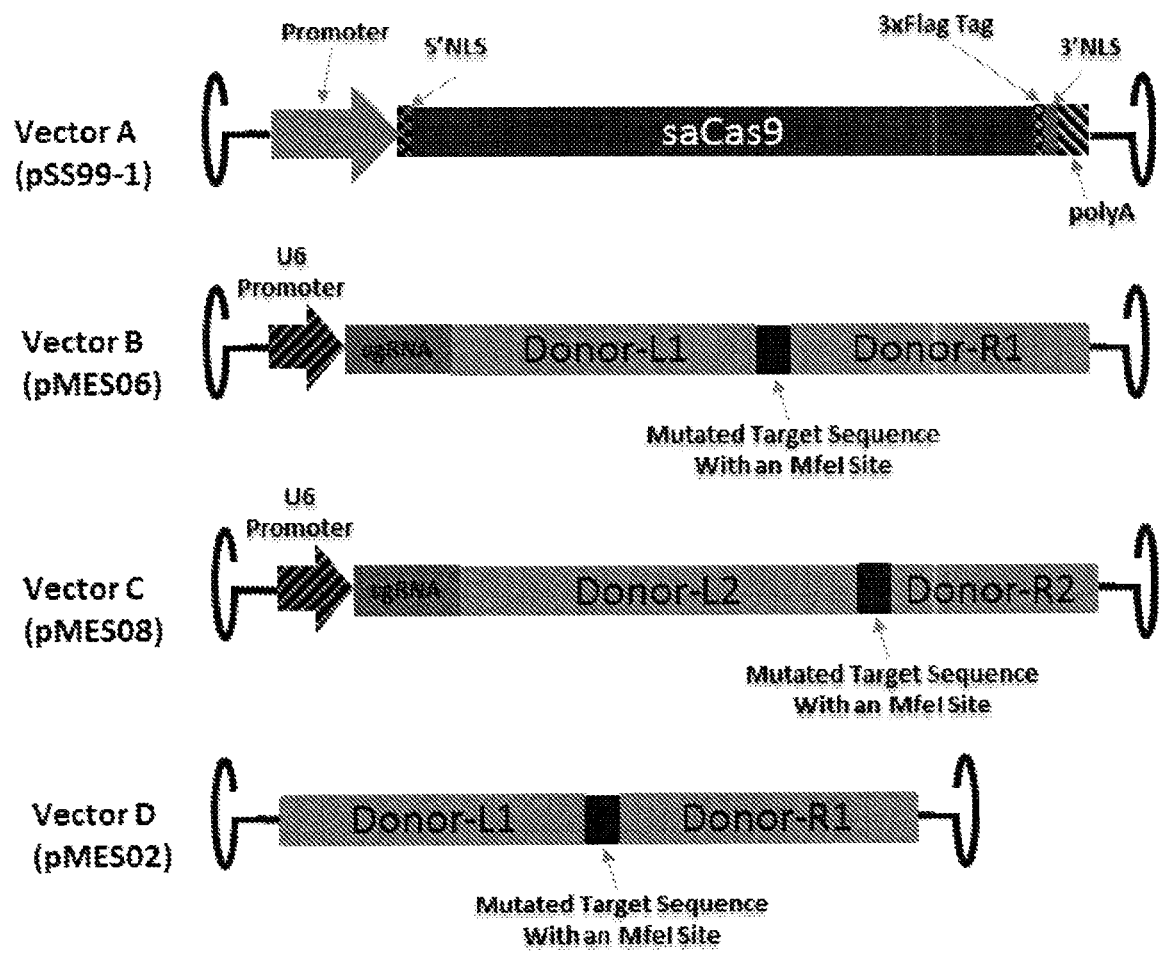
FIG. 15 provides schematic representations of vectors for use in methods of Approach 1A.
Figure 17A:
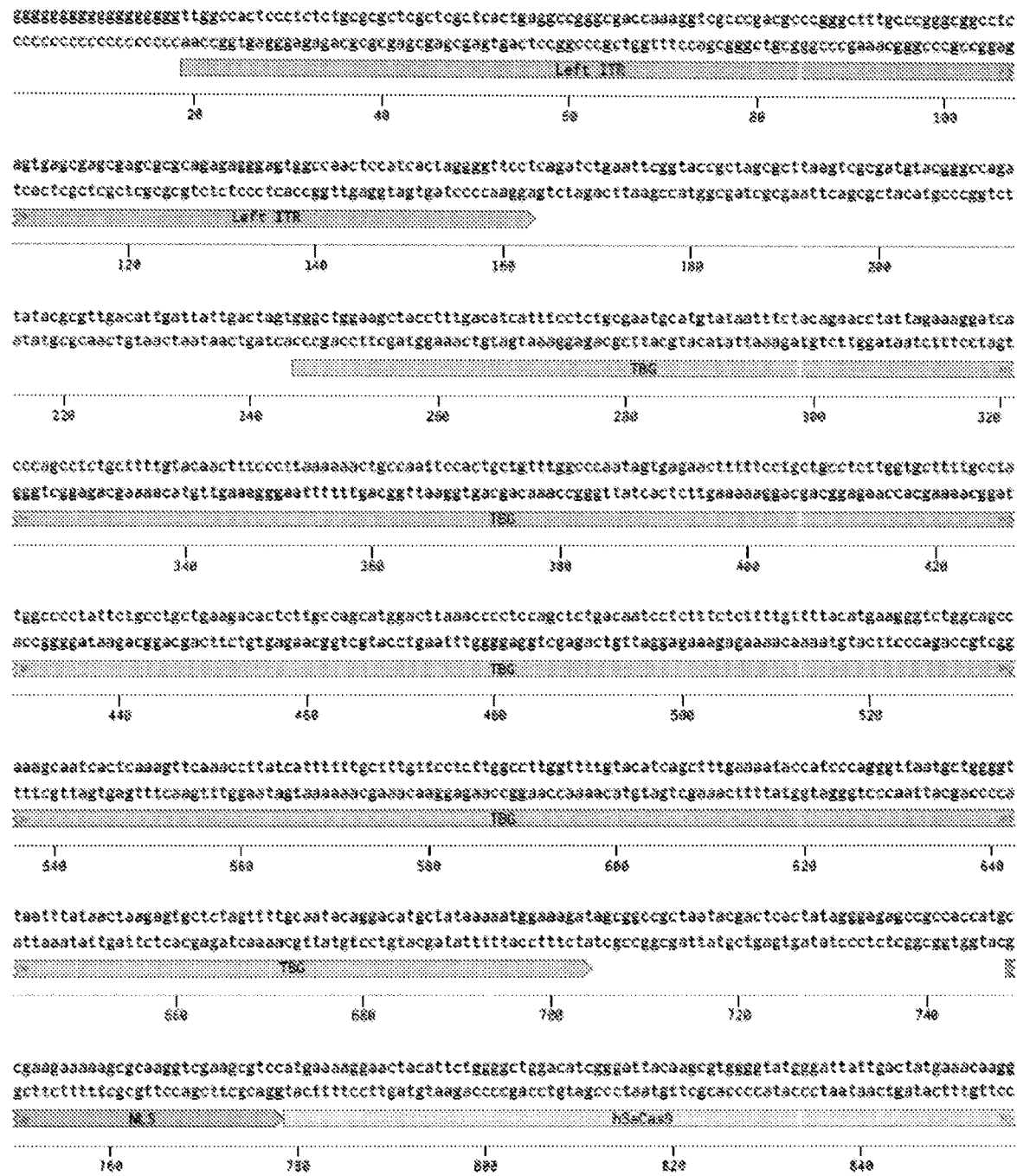
Figure 17B:
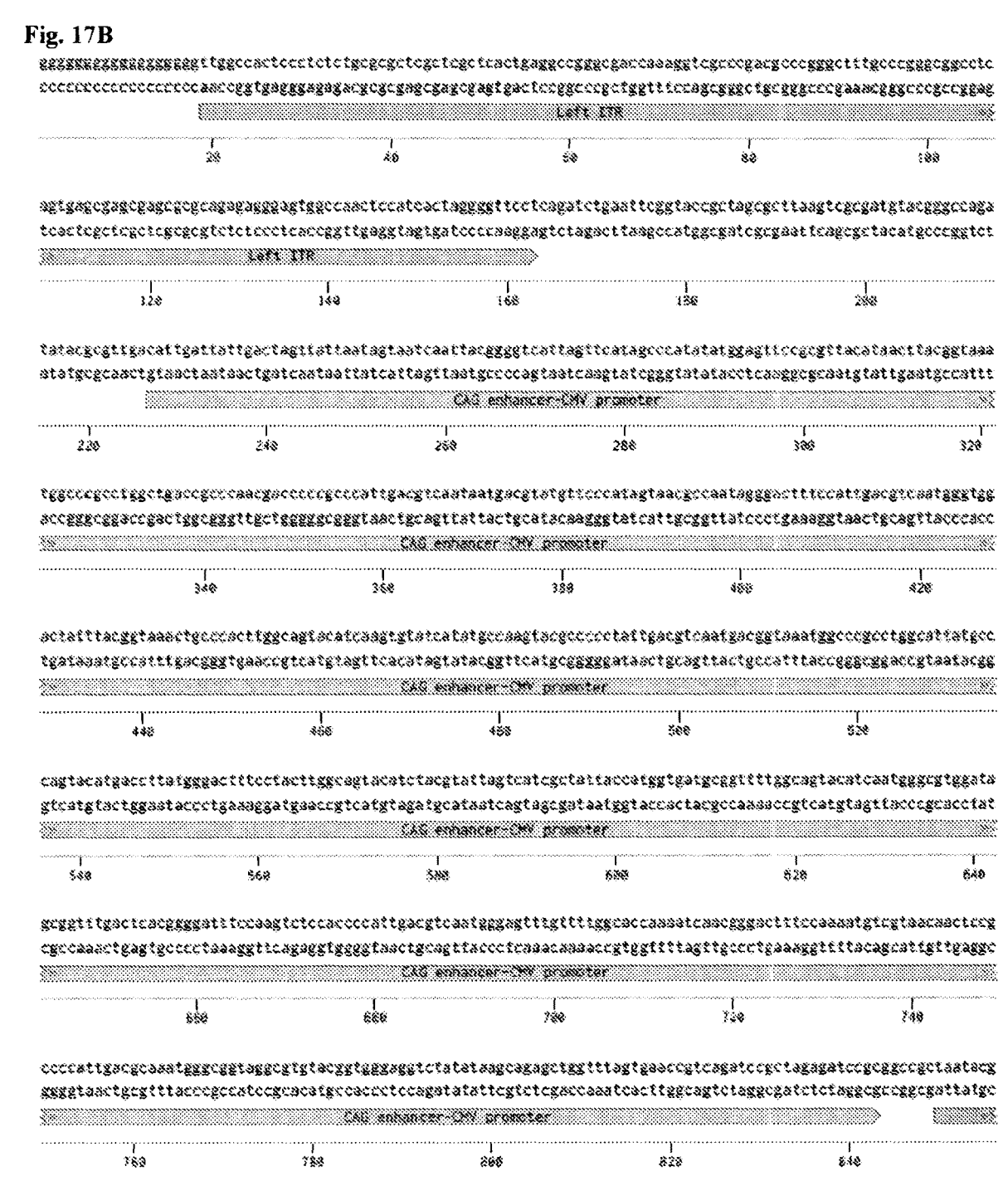
Figure 17B:
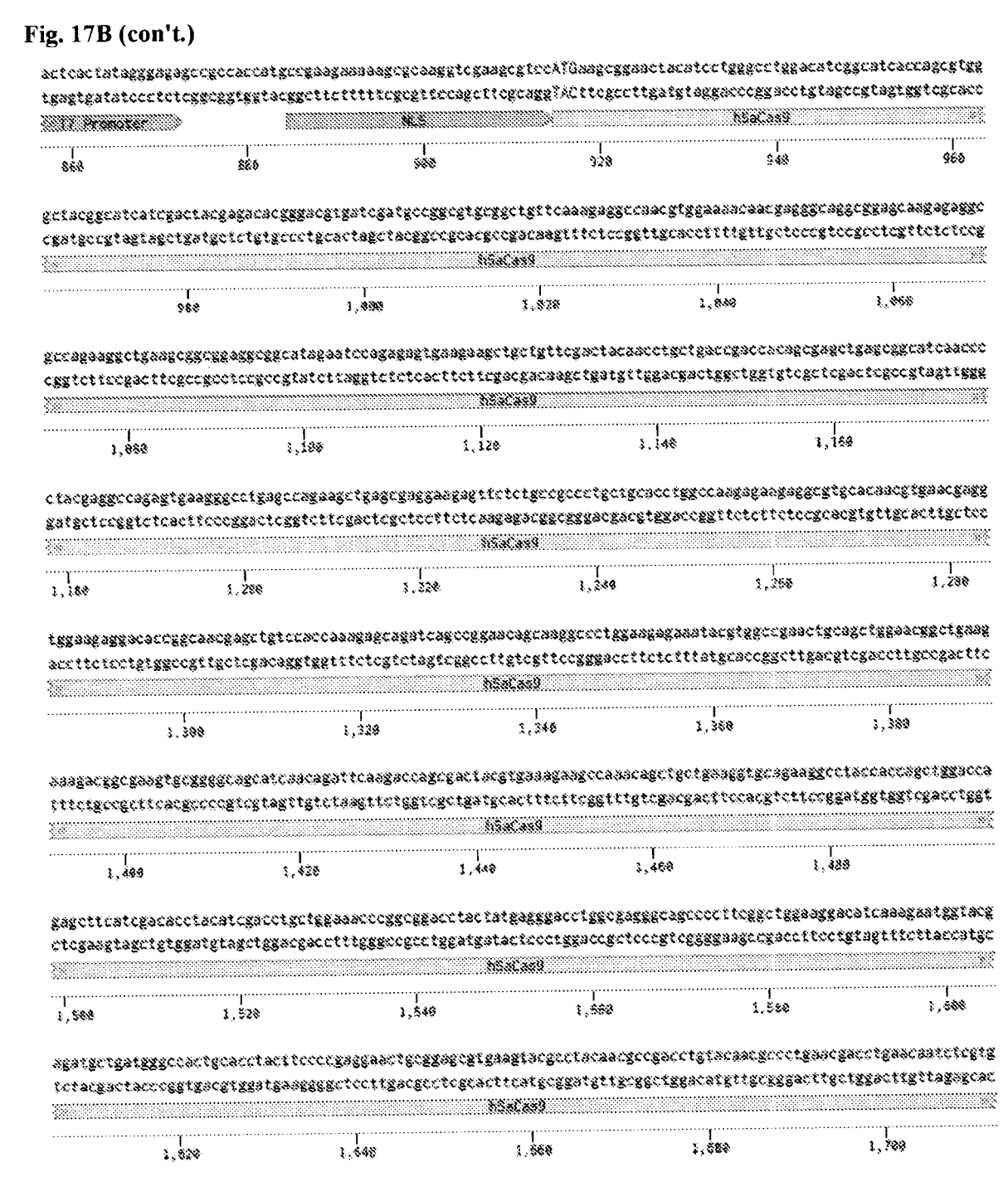
Figure 17B:
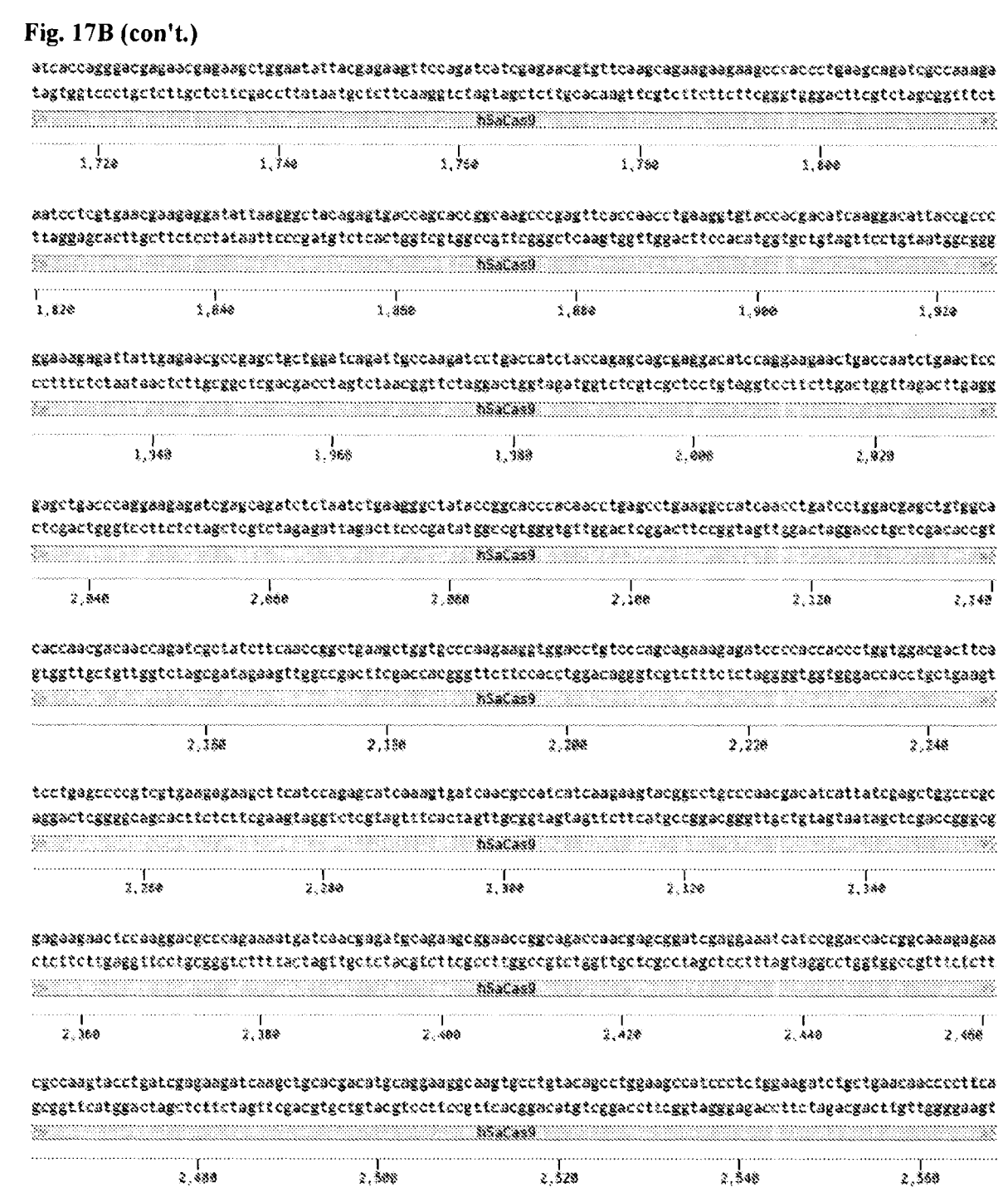
Figure 17B:
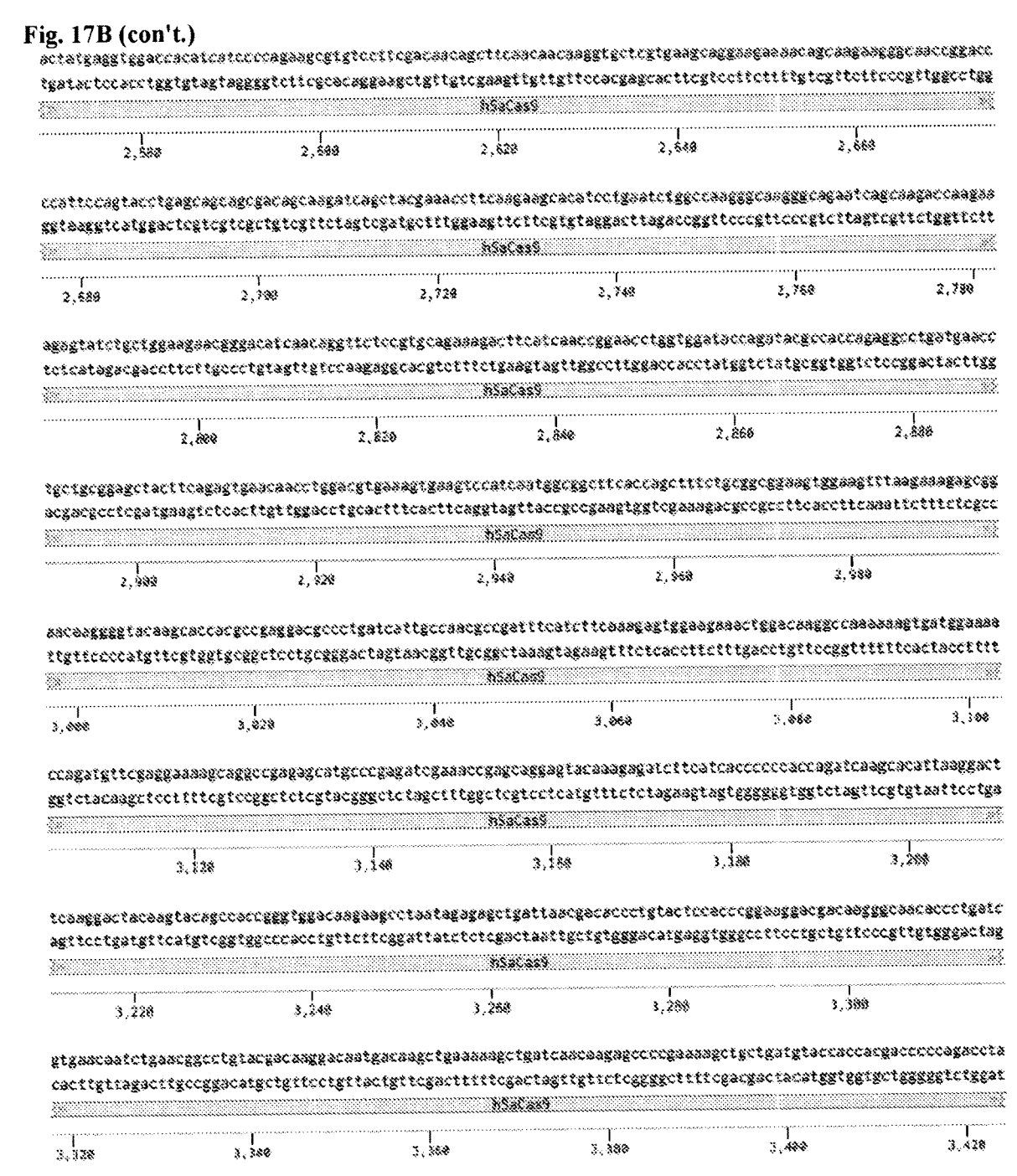
Figure 17B:
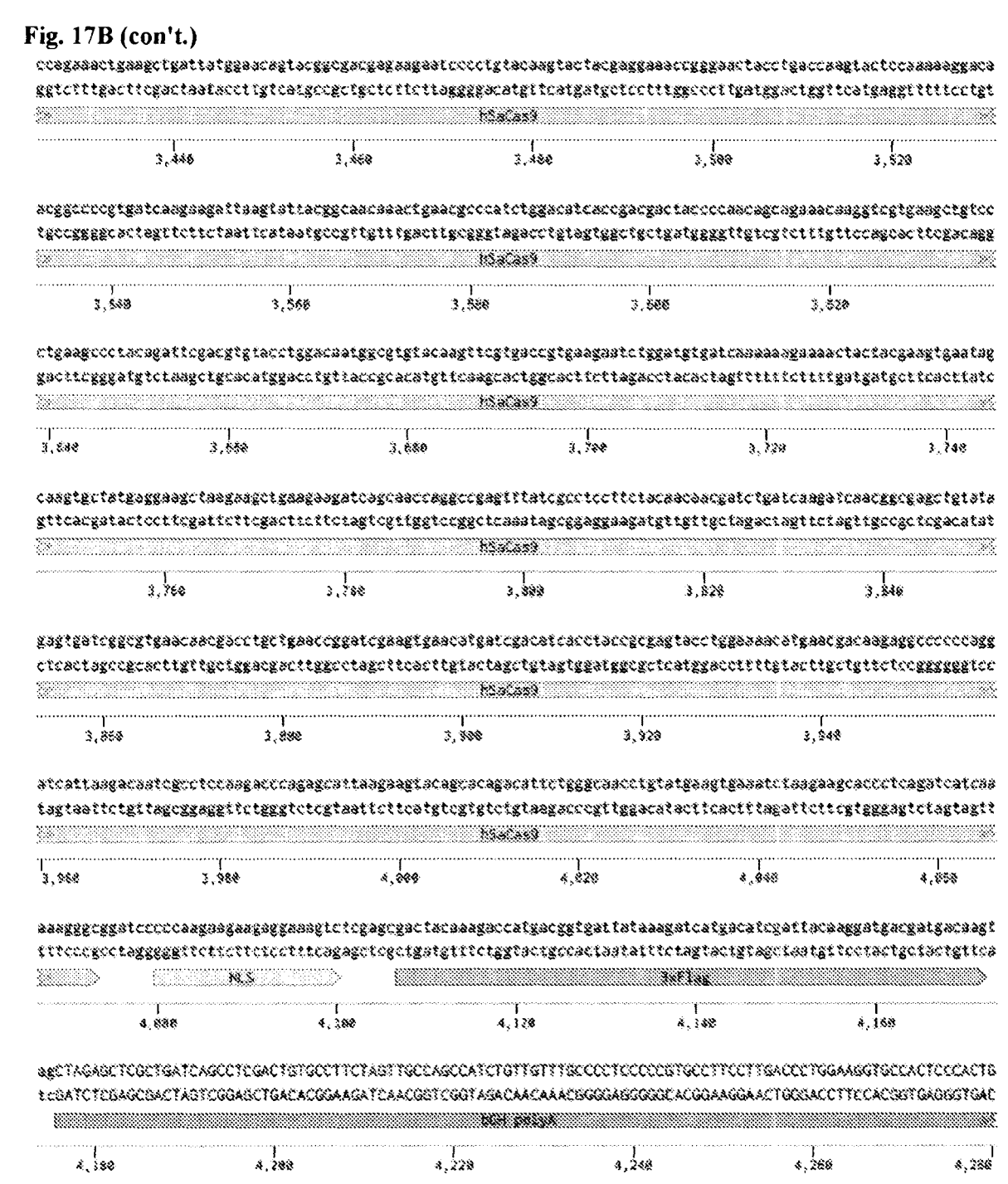
Figure 17B:
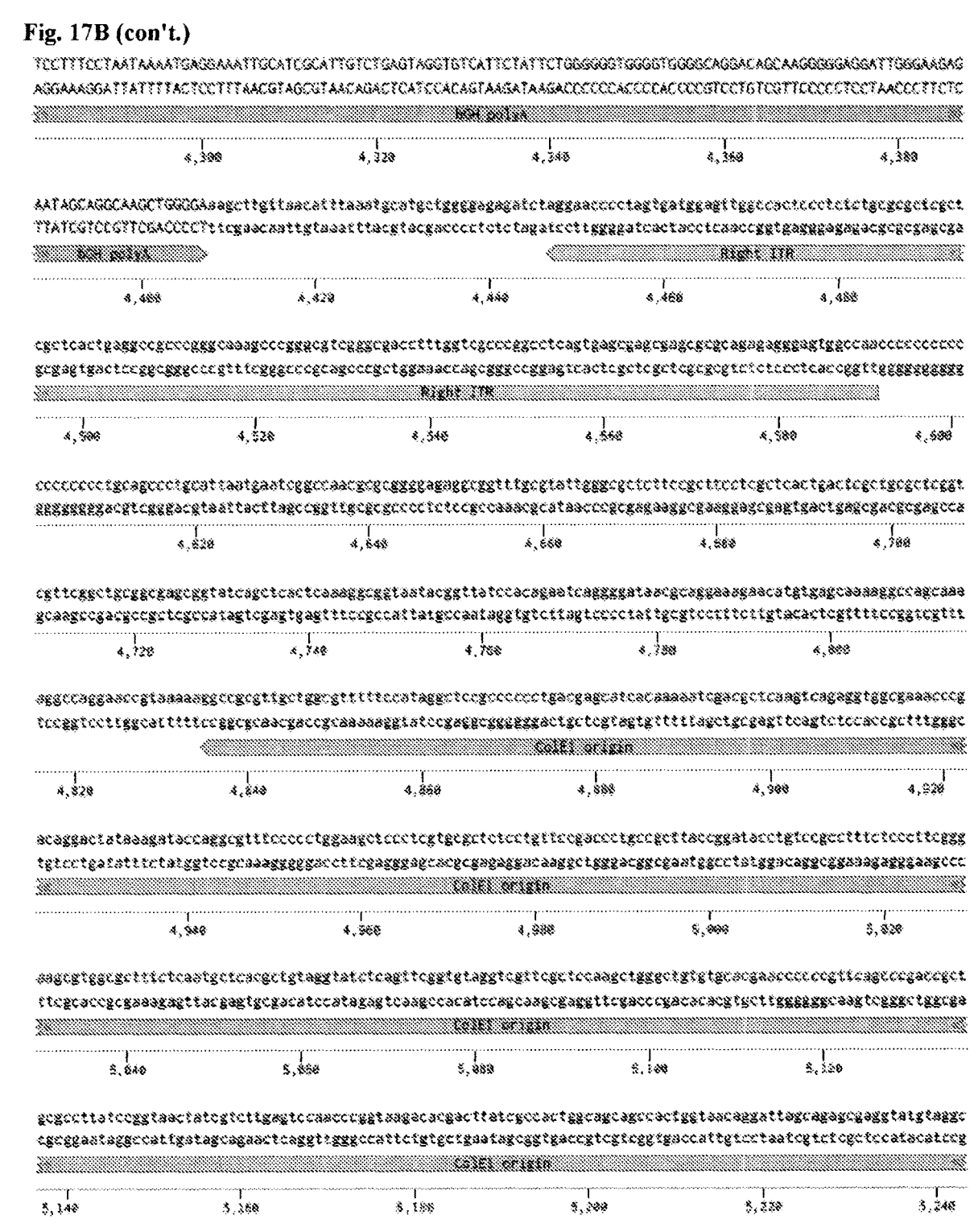
Figure 17B:
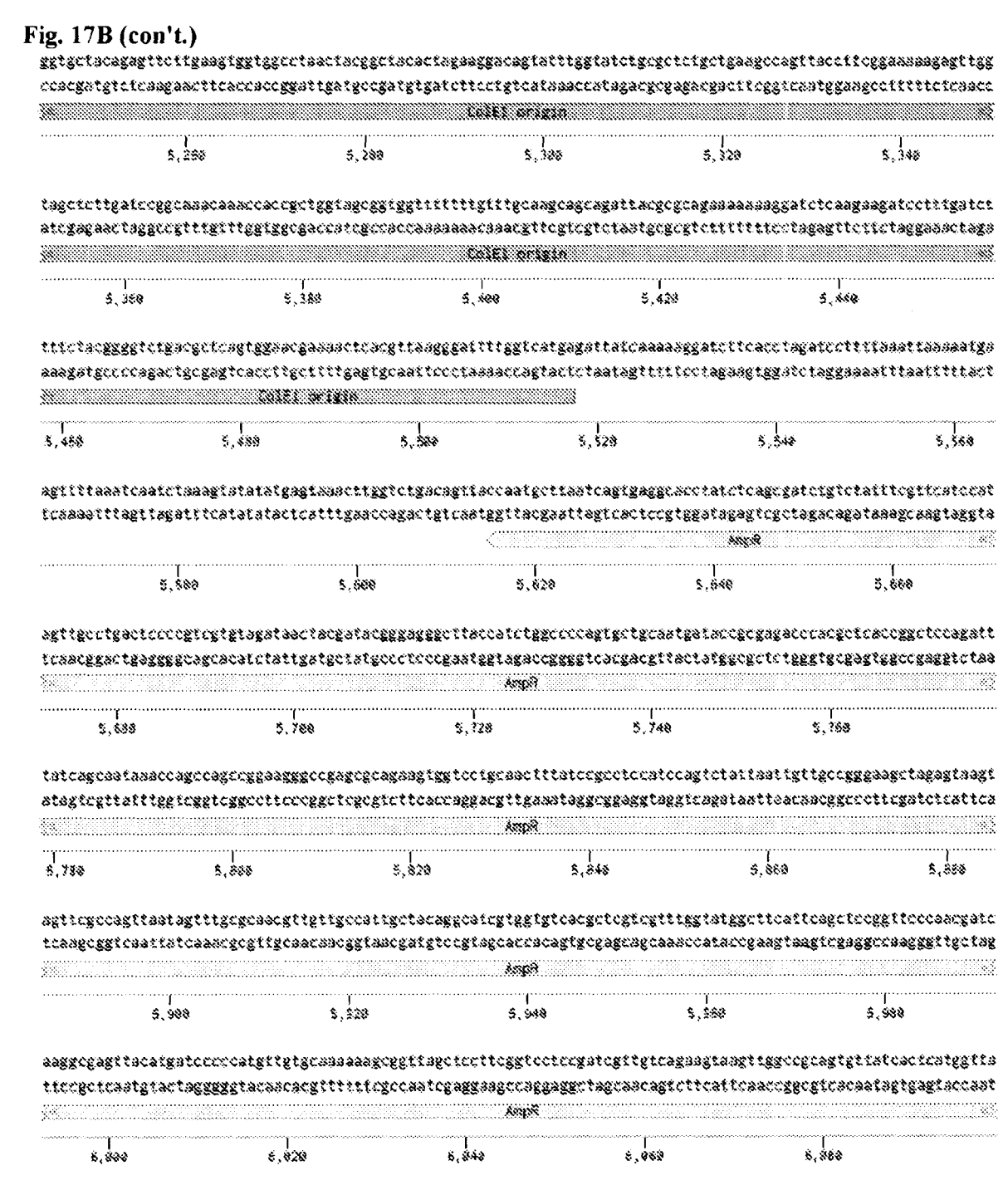
Figure 17B:
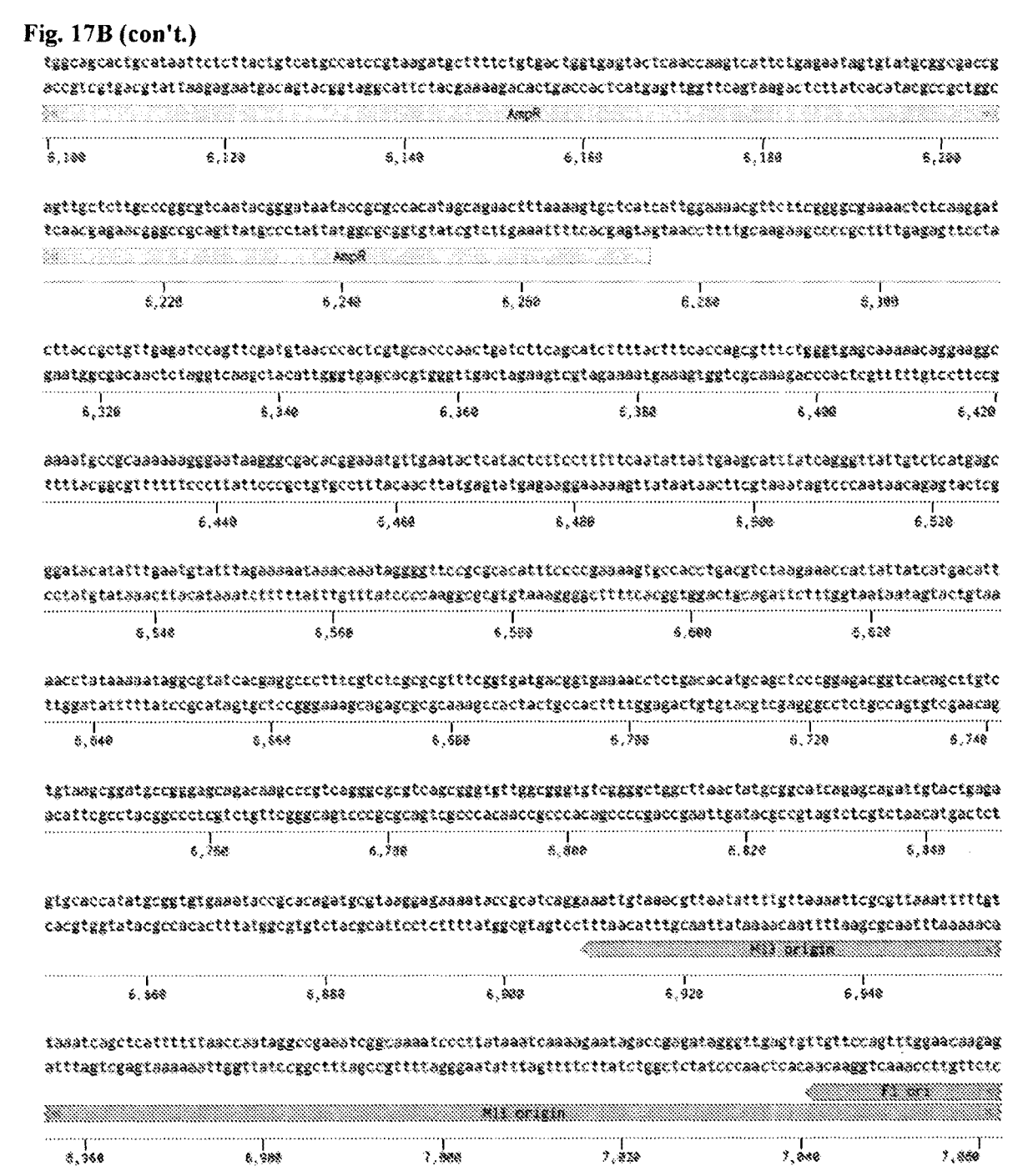
Figure 17B:
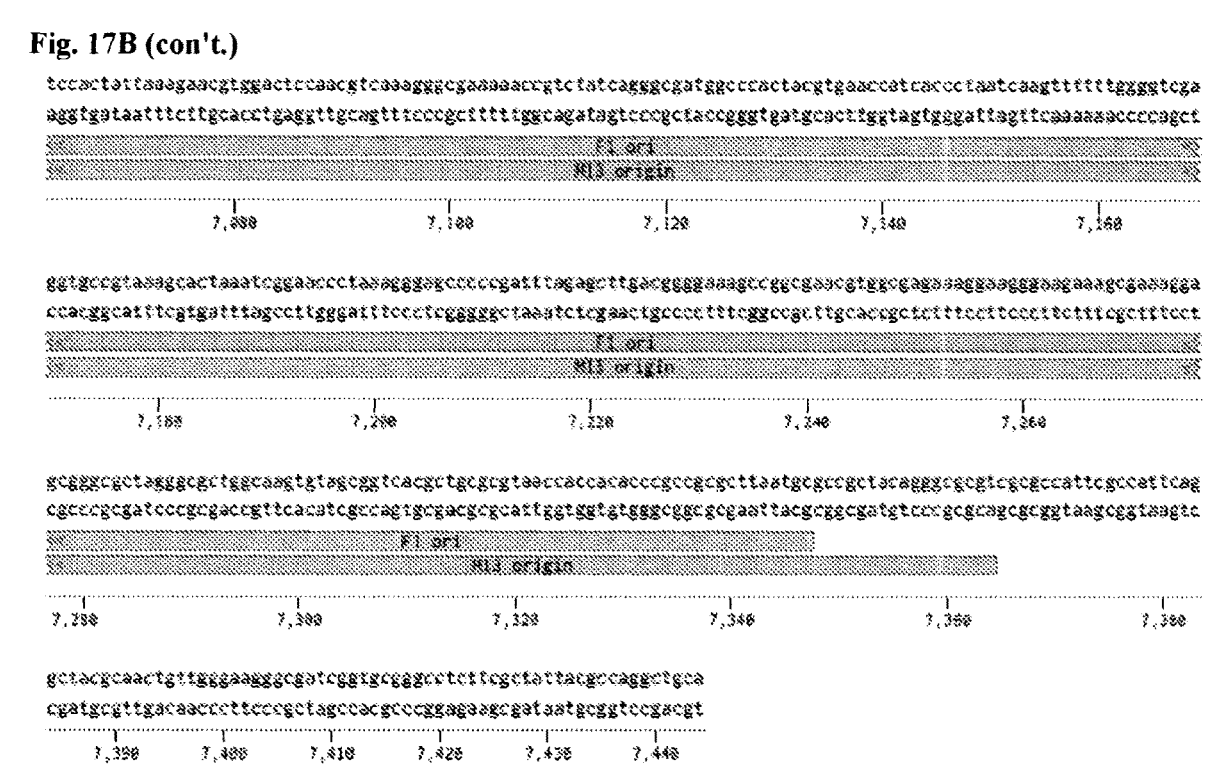
Figure 17C:
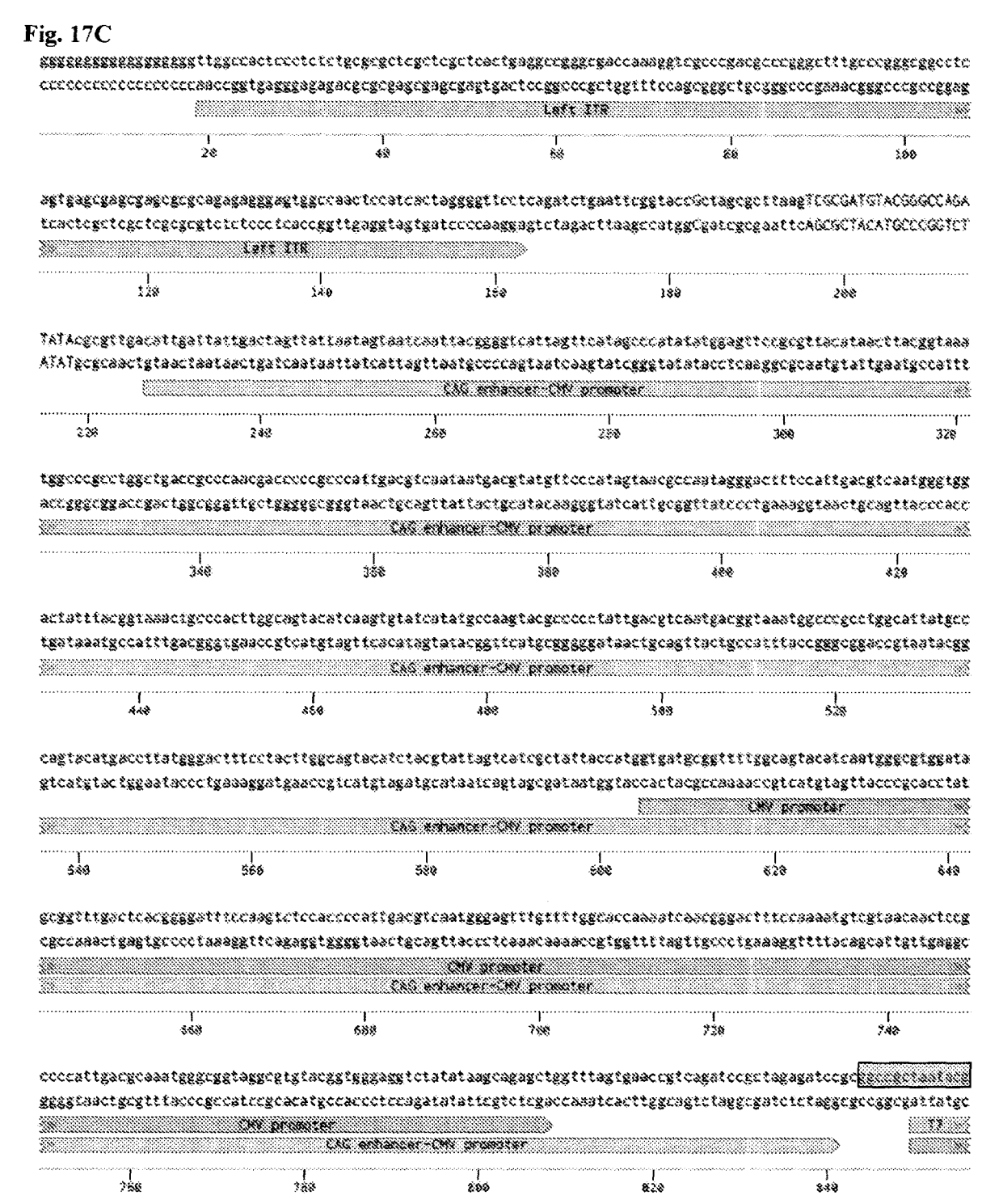
Figure 17C:
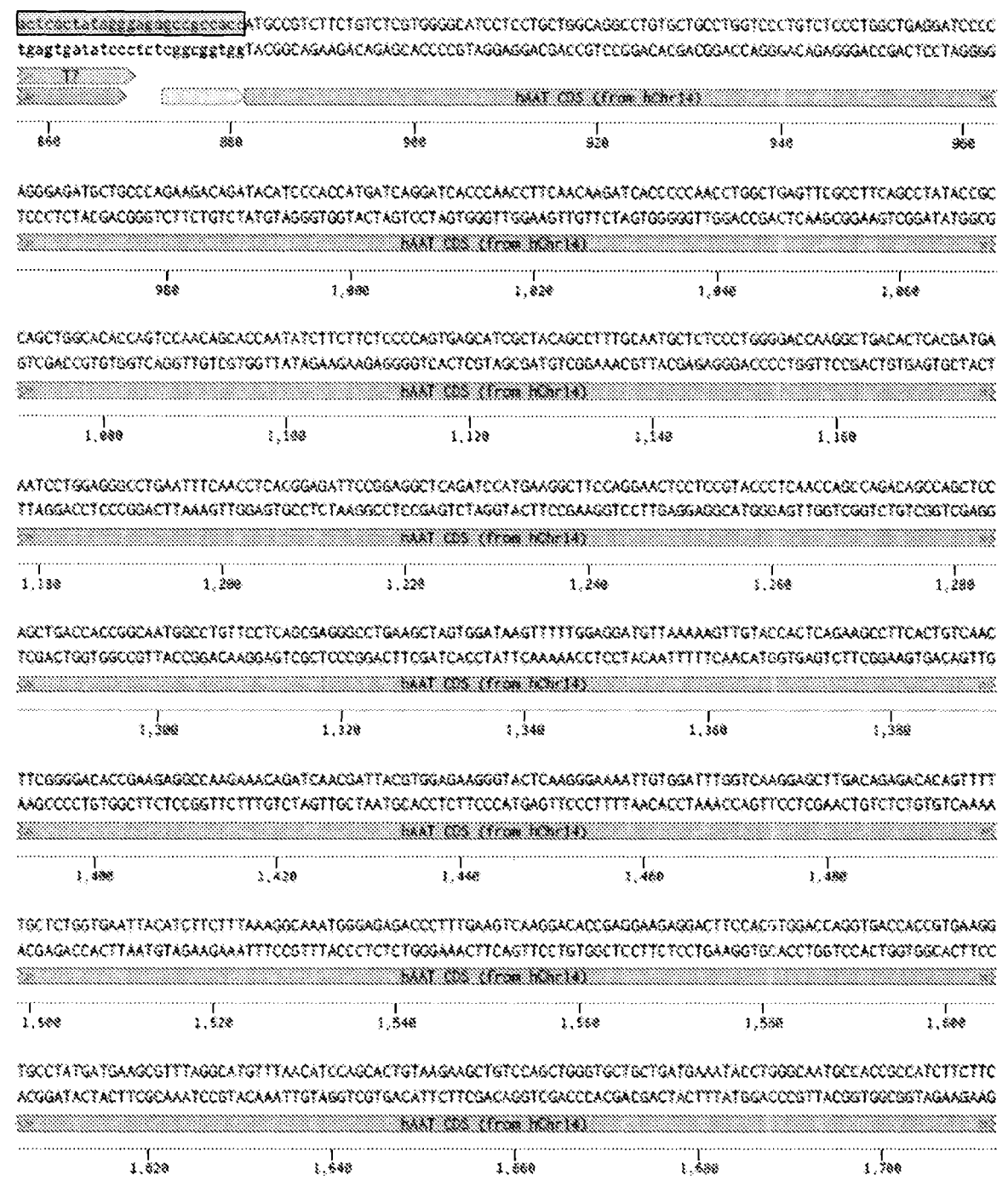
Figure 17C:
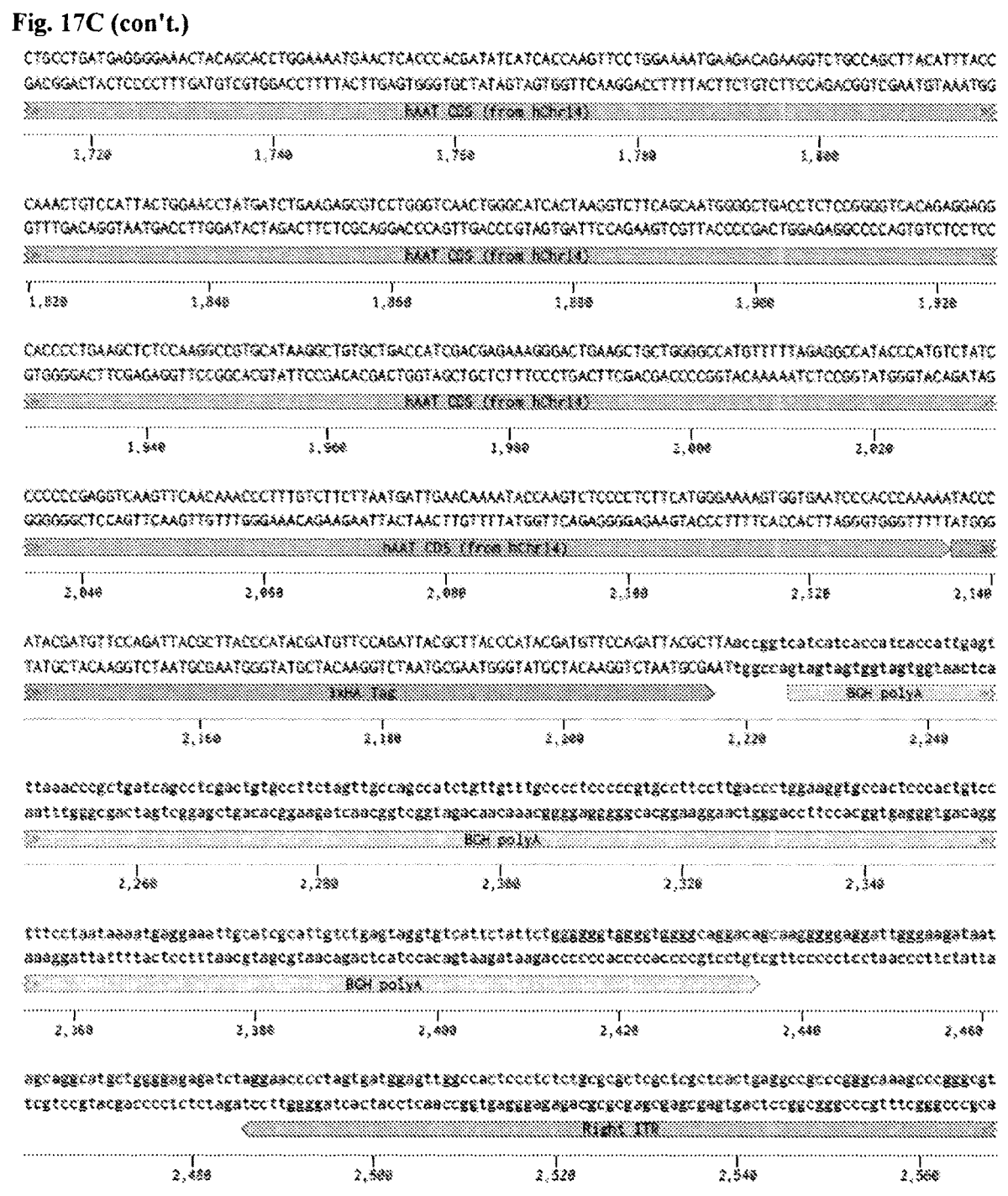
Figure 17C:
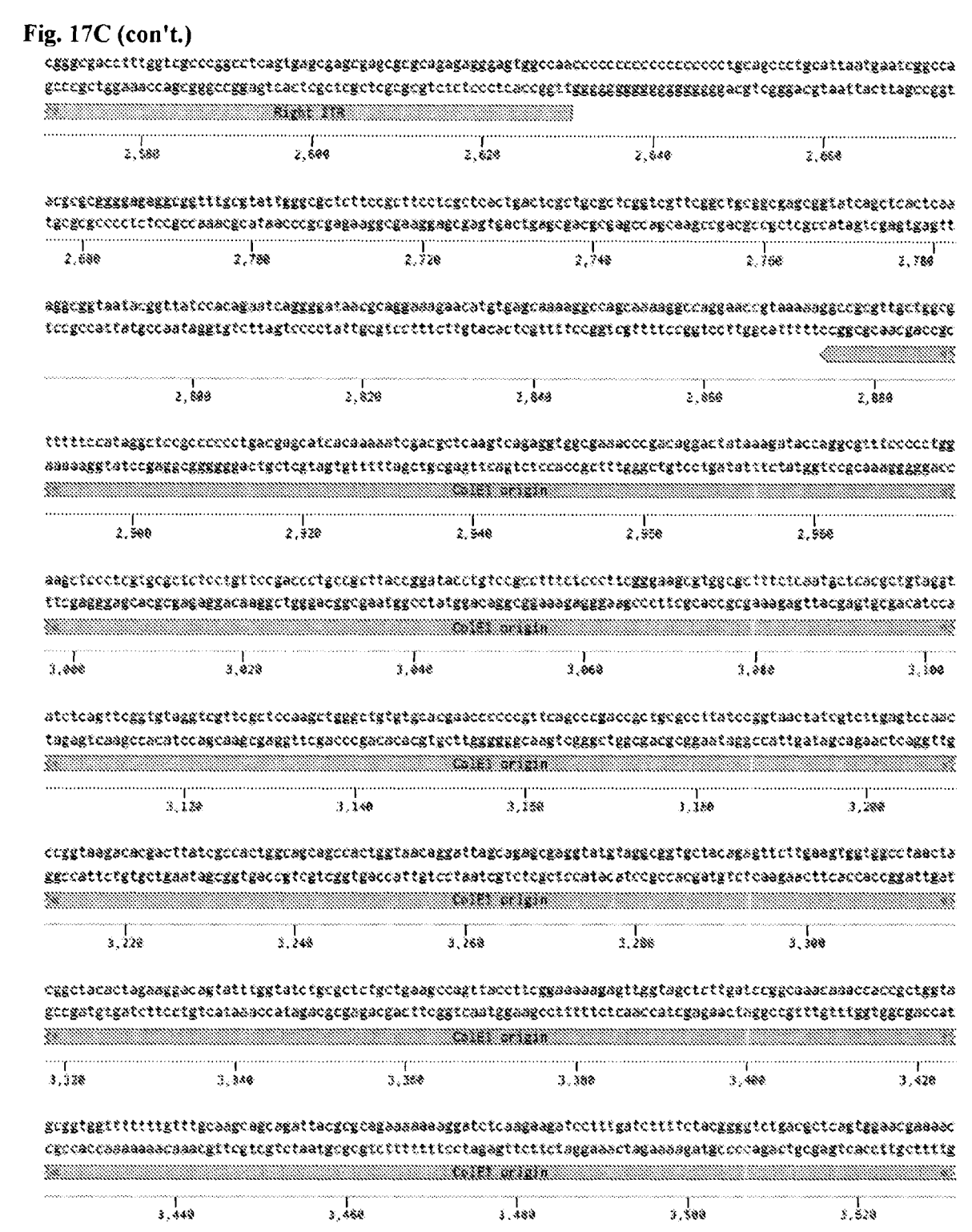
Figure 17C:
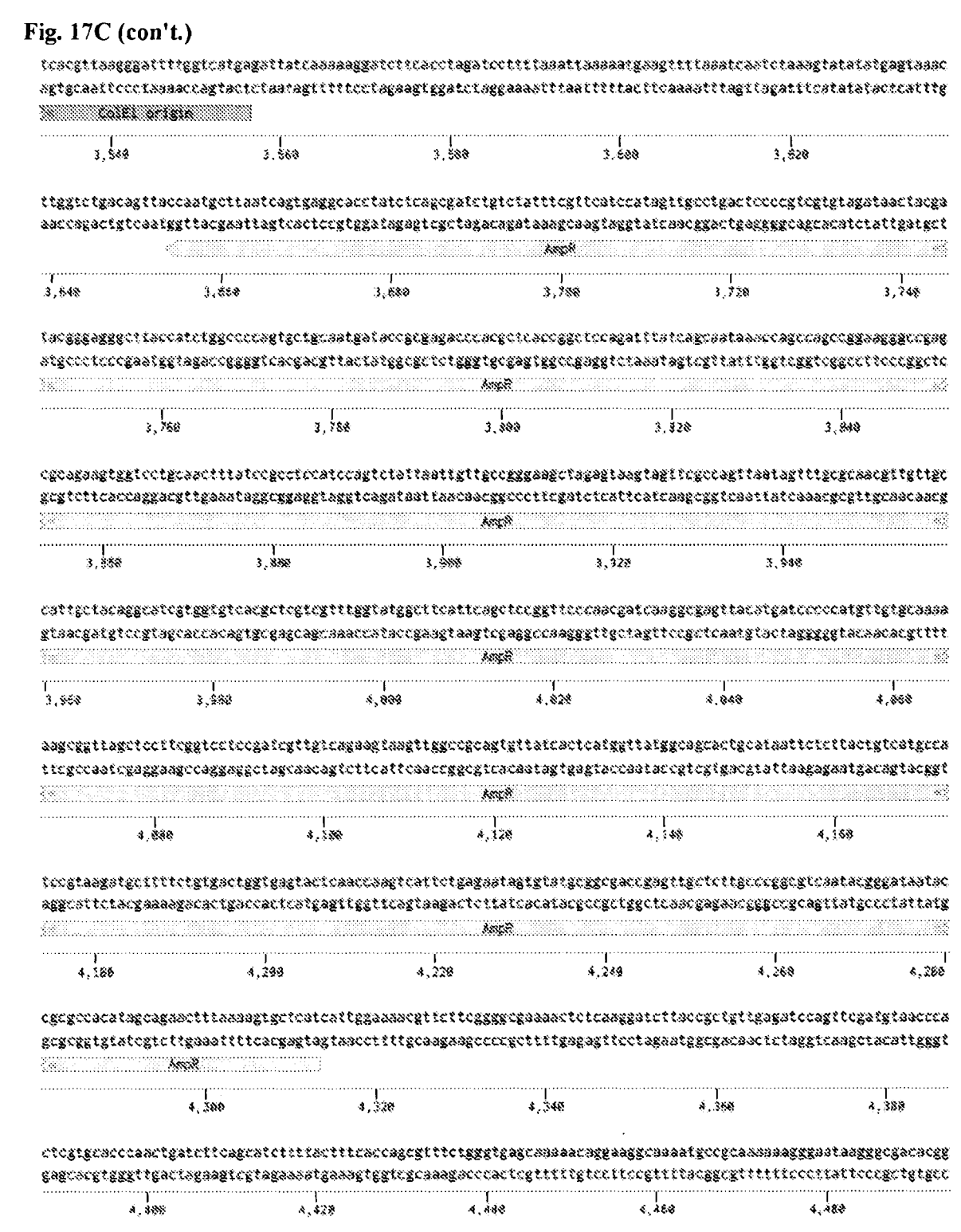
Figure 17C:
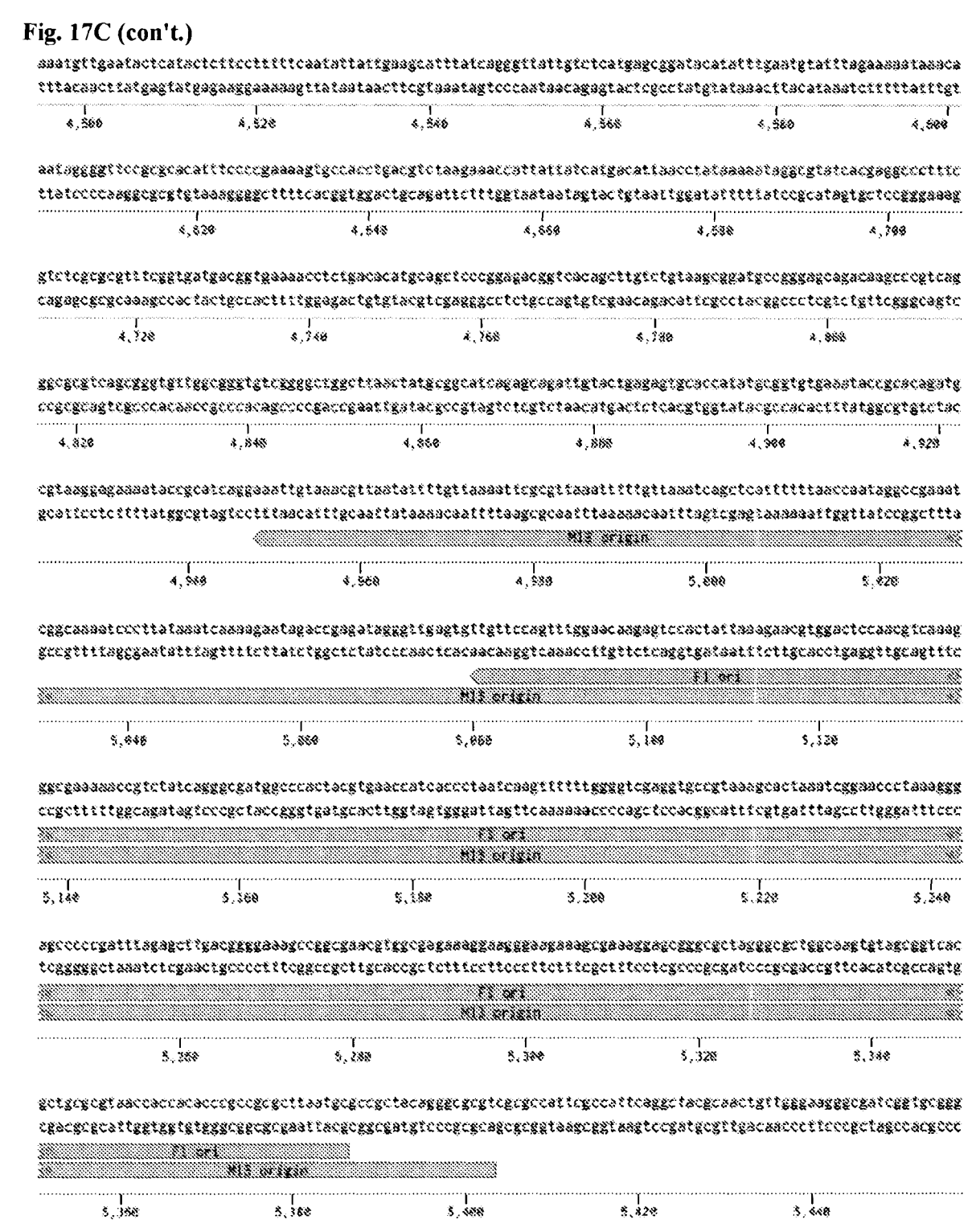
Figure 17D:
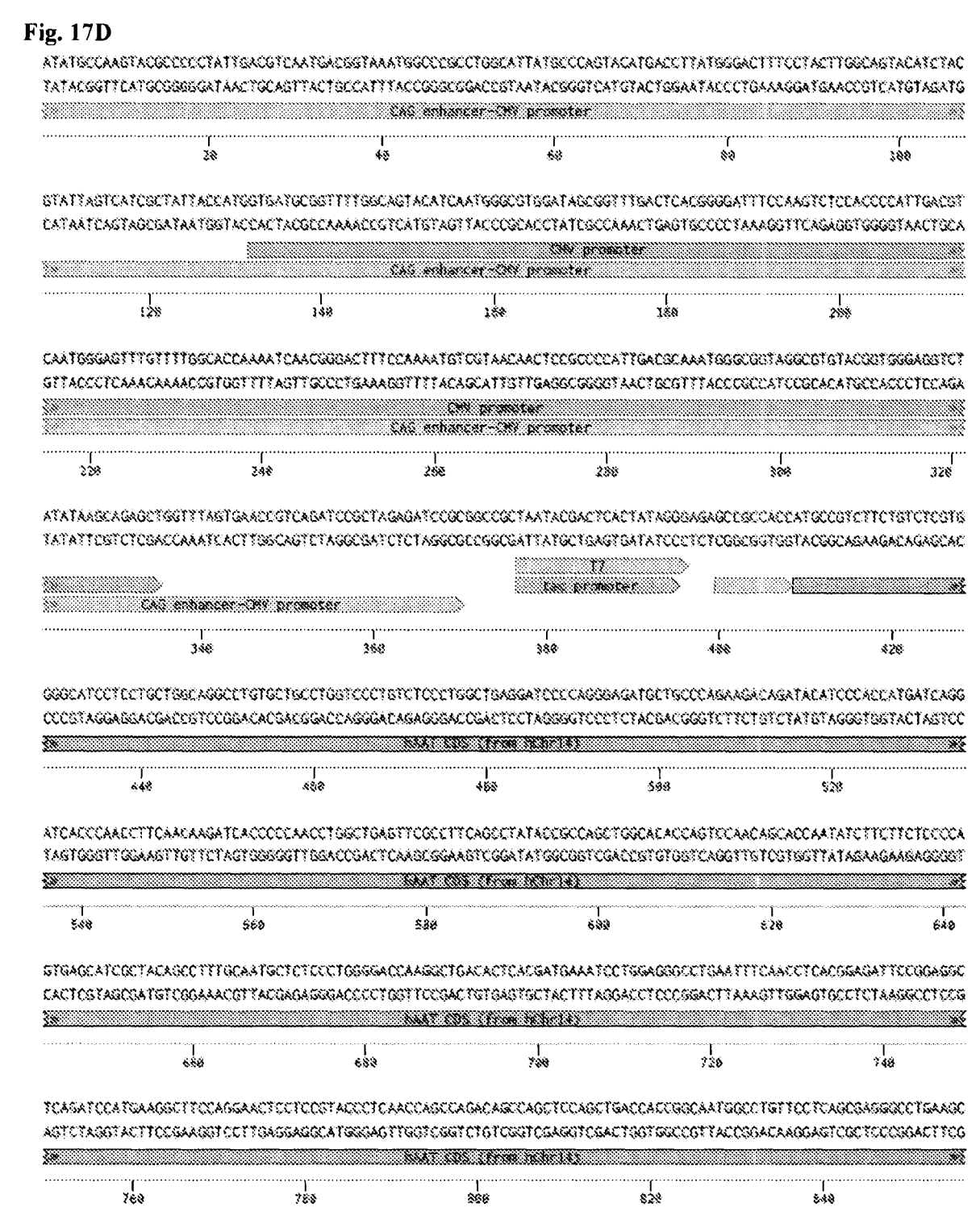
Figure 17D:
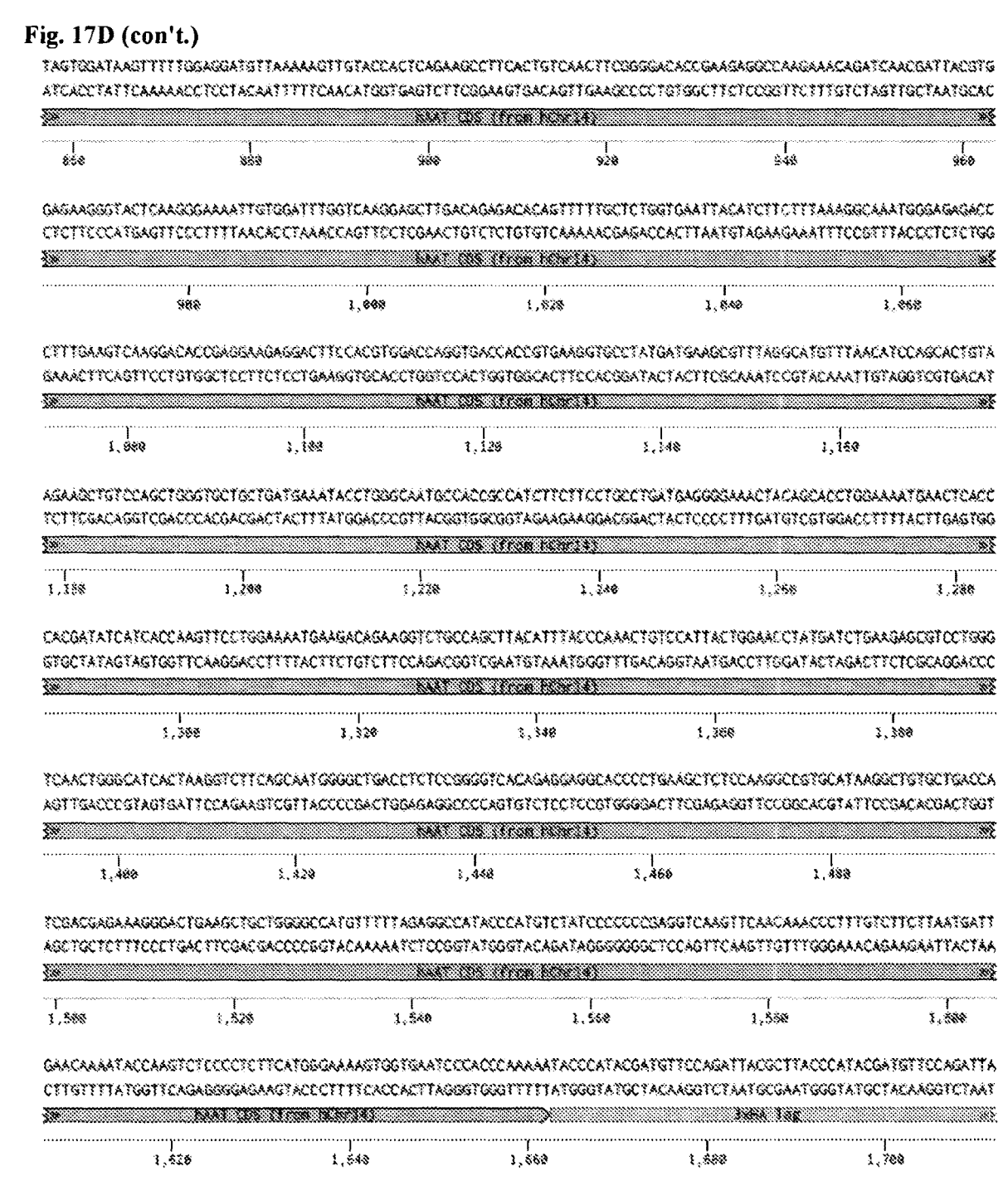
Figure 17D:
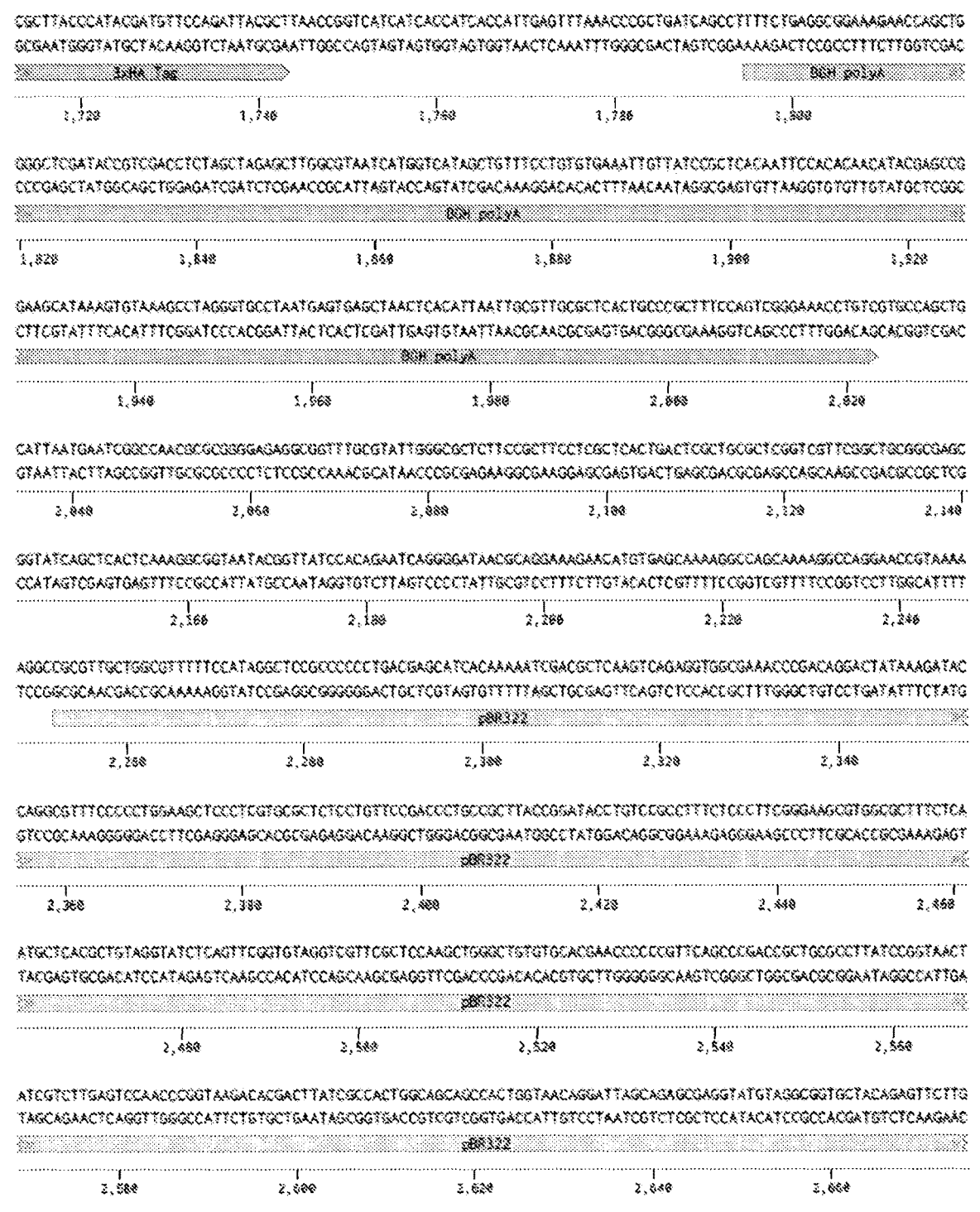
Figure 17D:
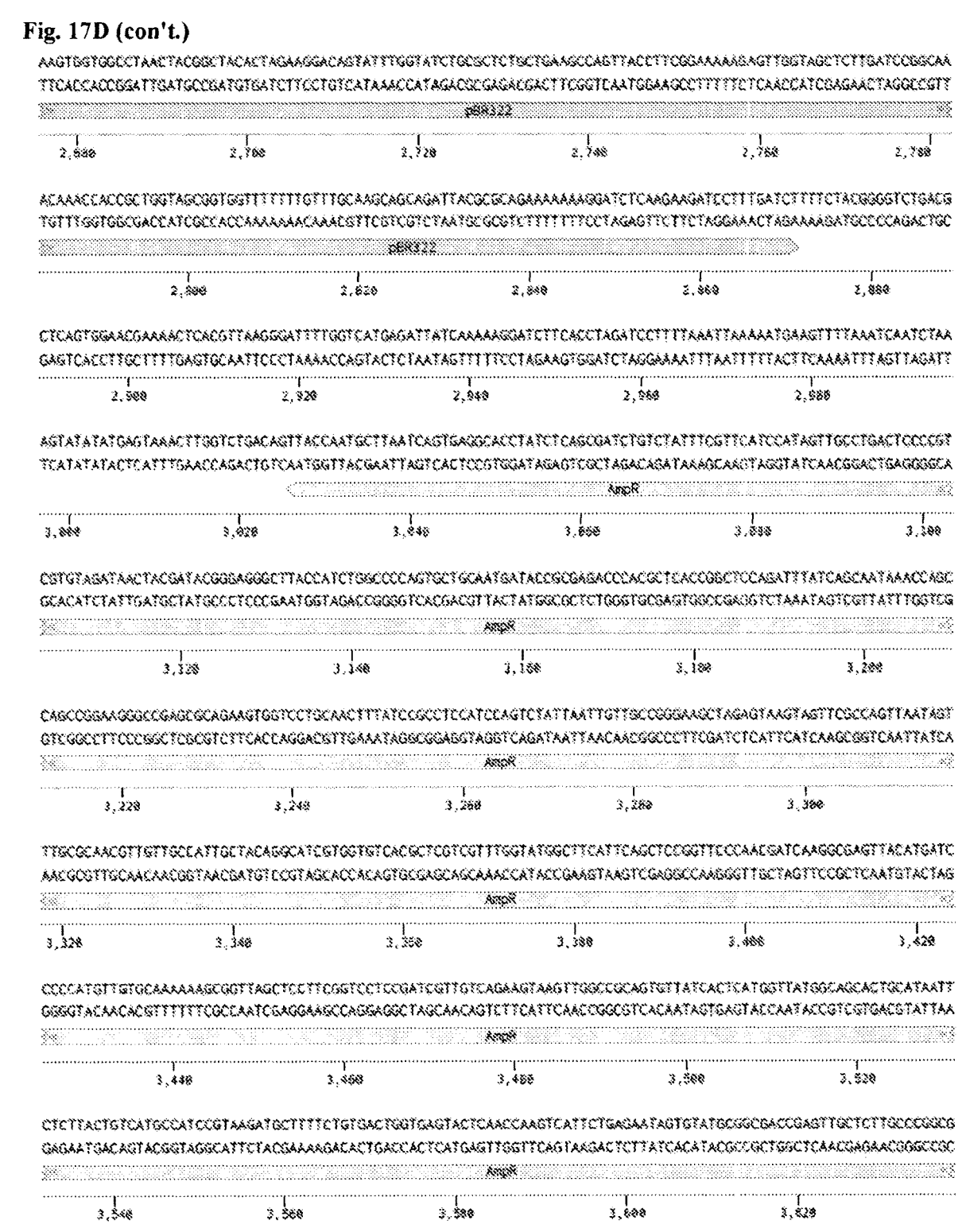
Figure 17D:
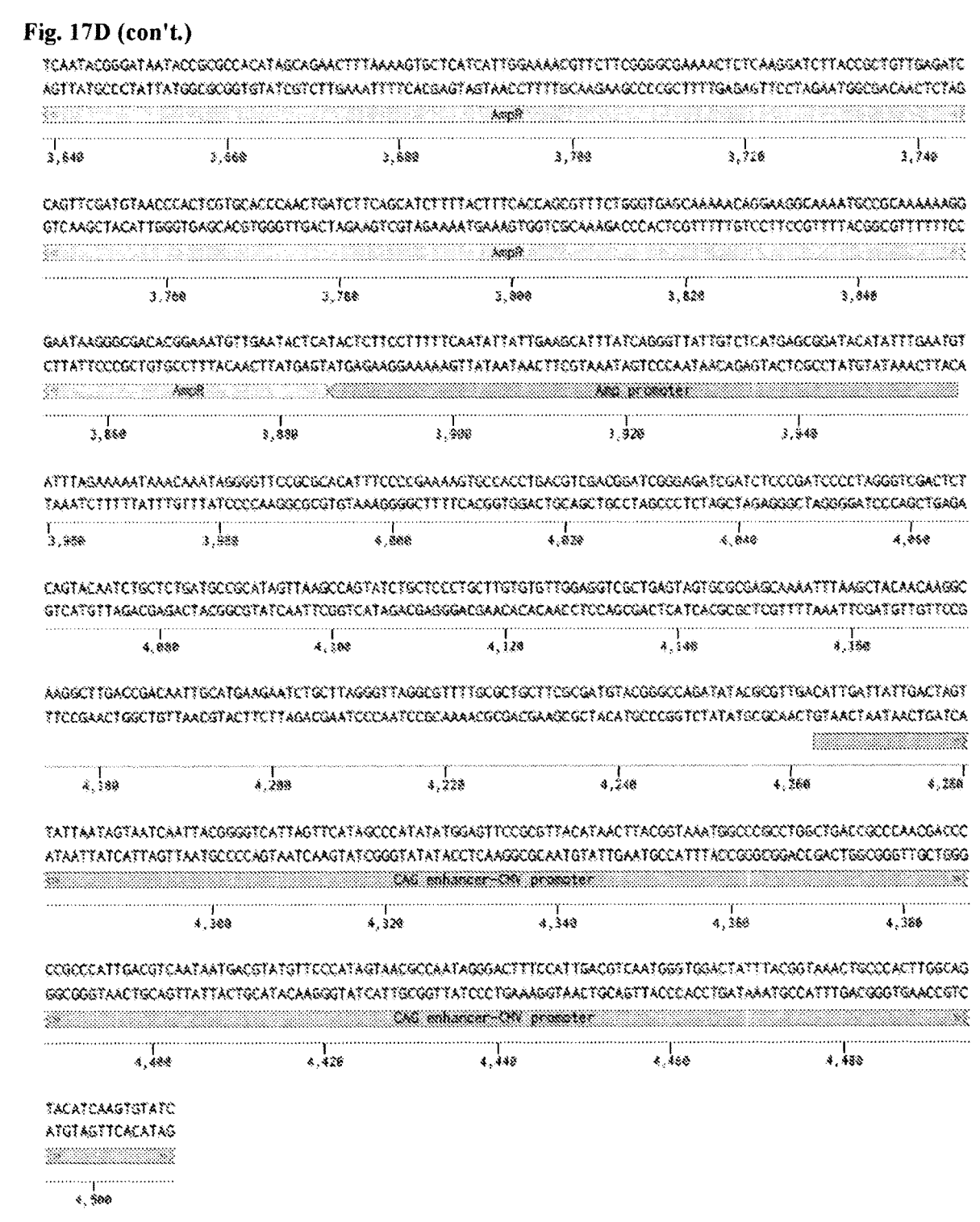
Figure 17E:
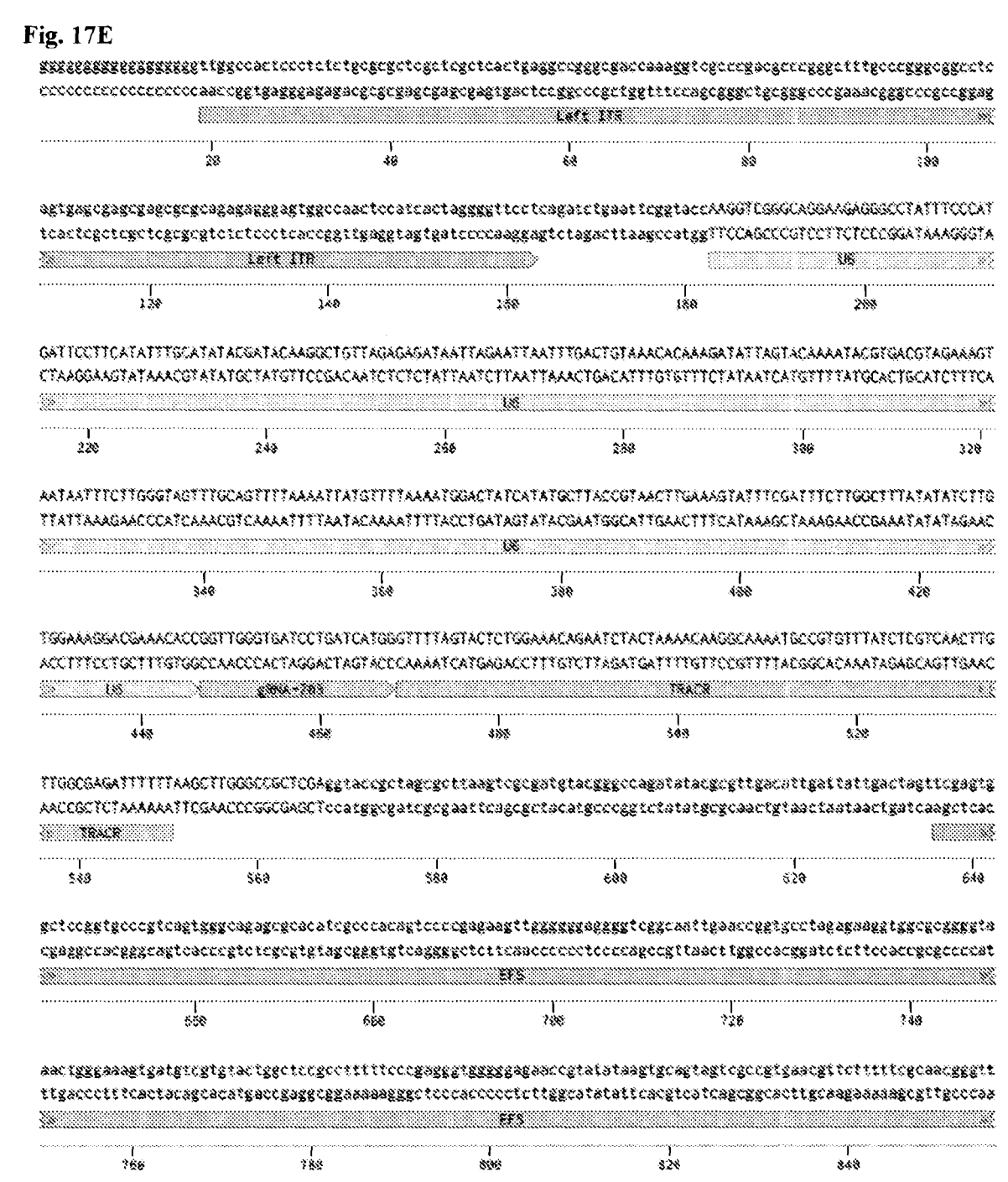
Figure 17E:
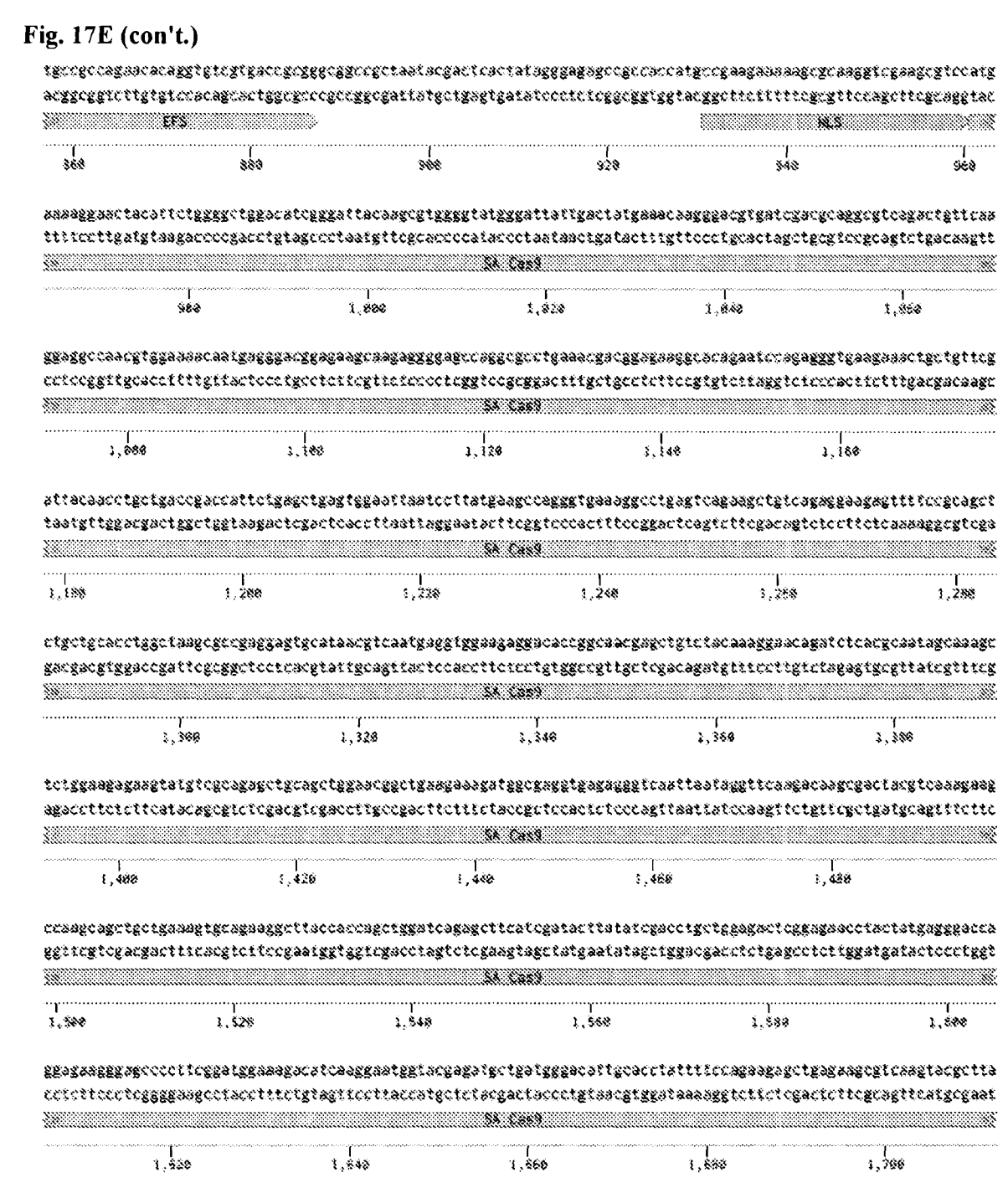
Figure 17E:
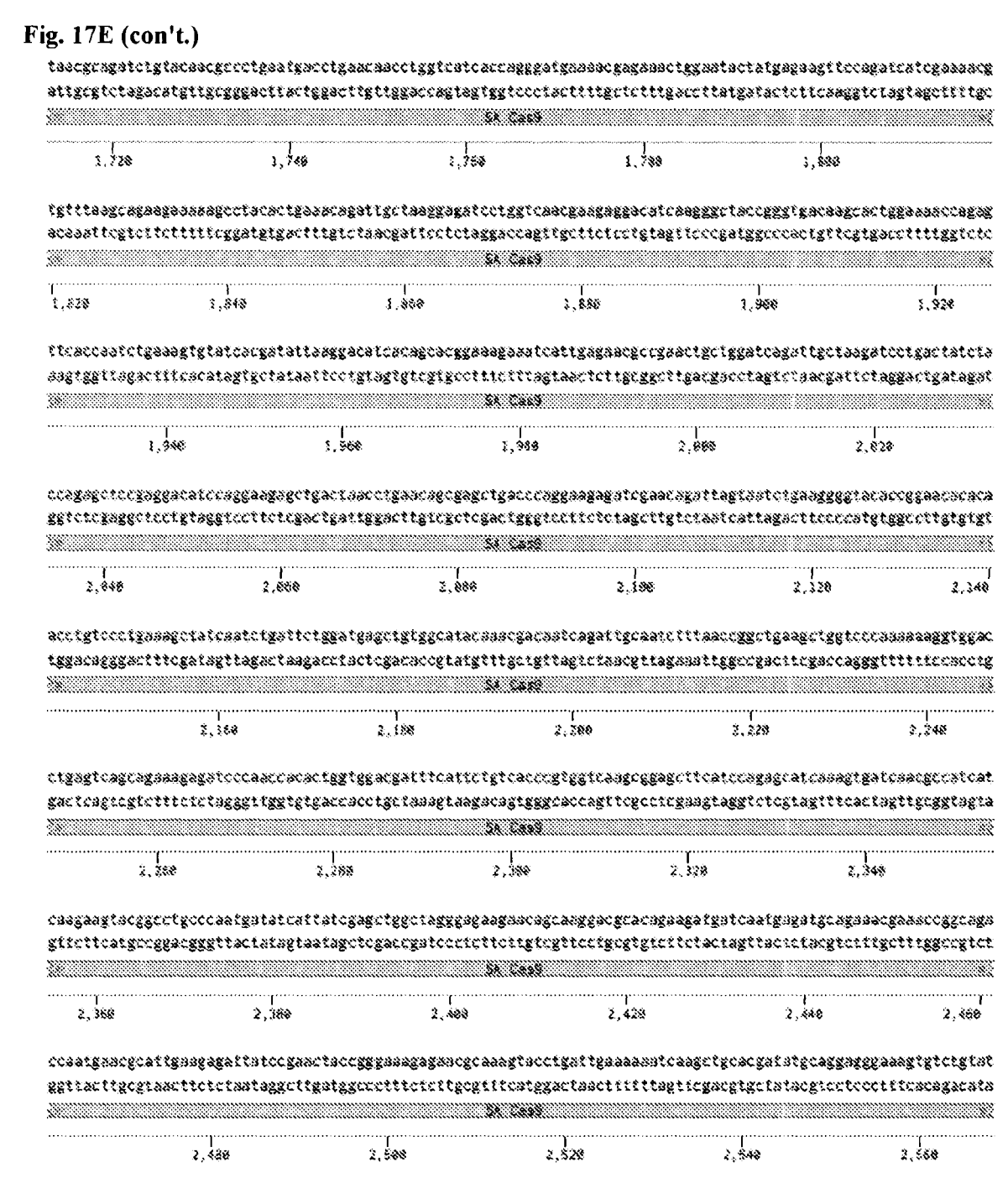
Figure 17E:
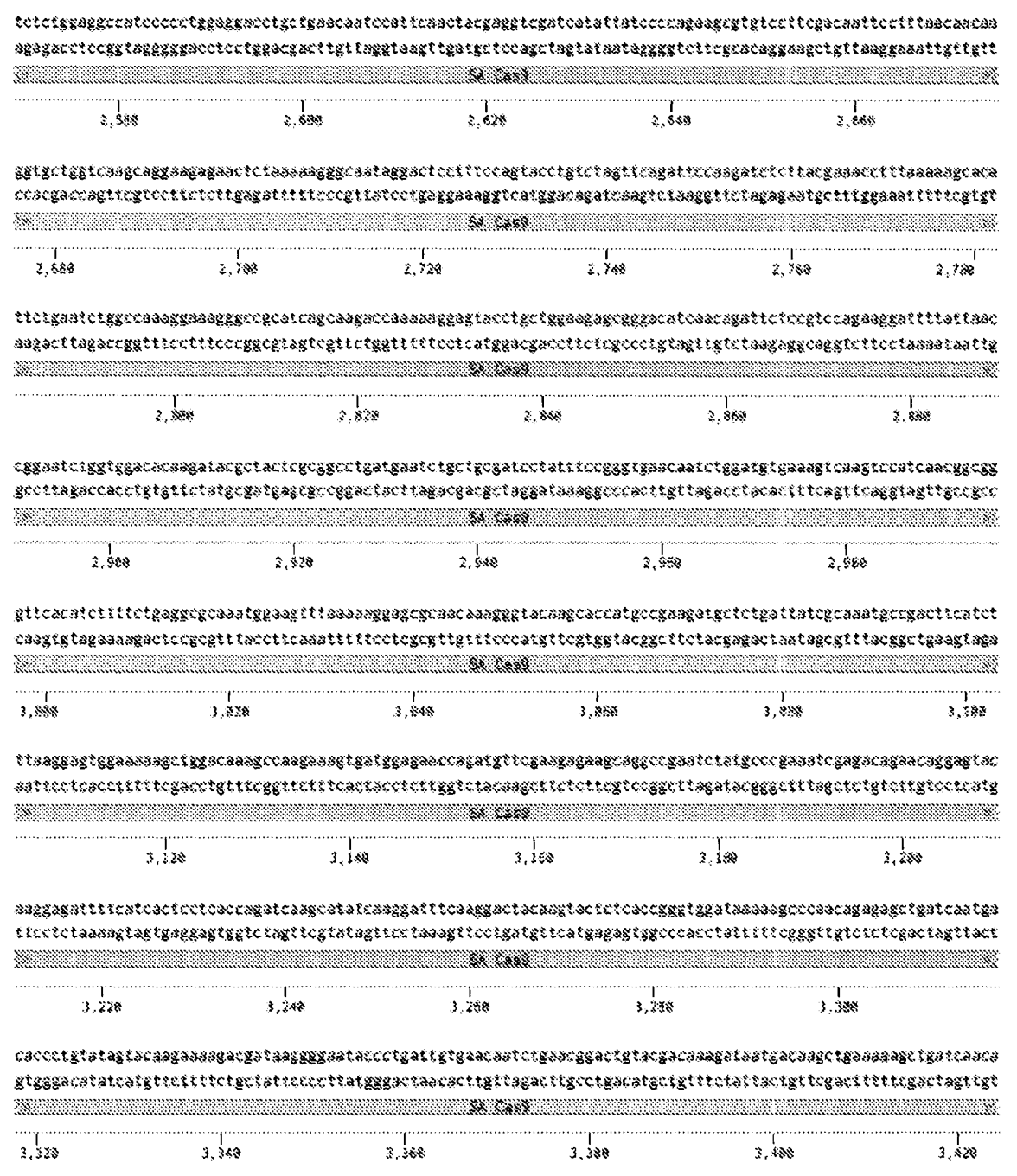
Figure 17E:
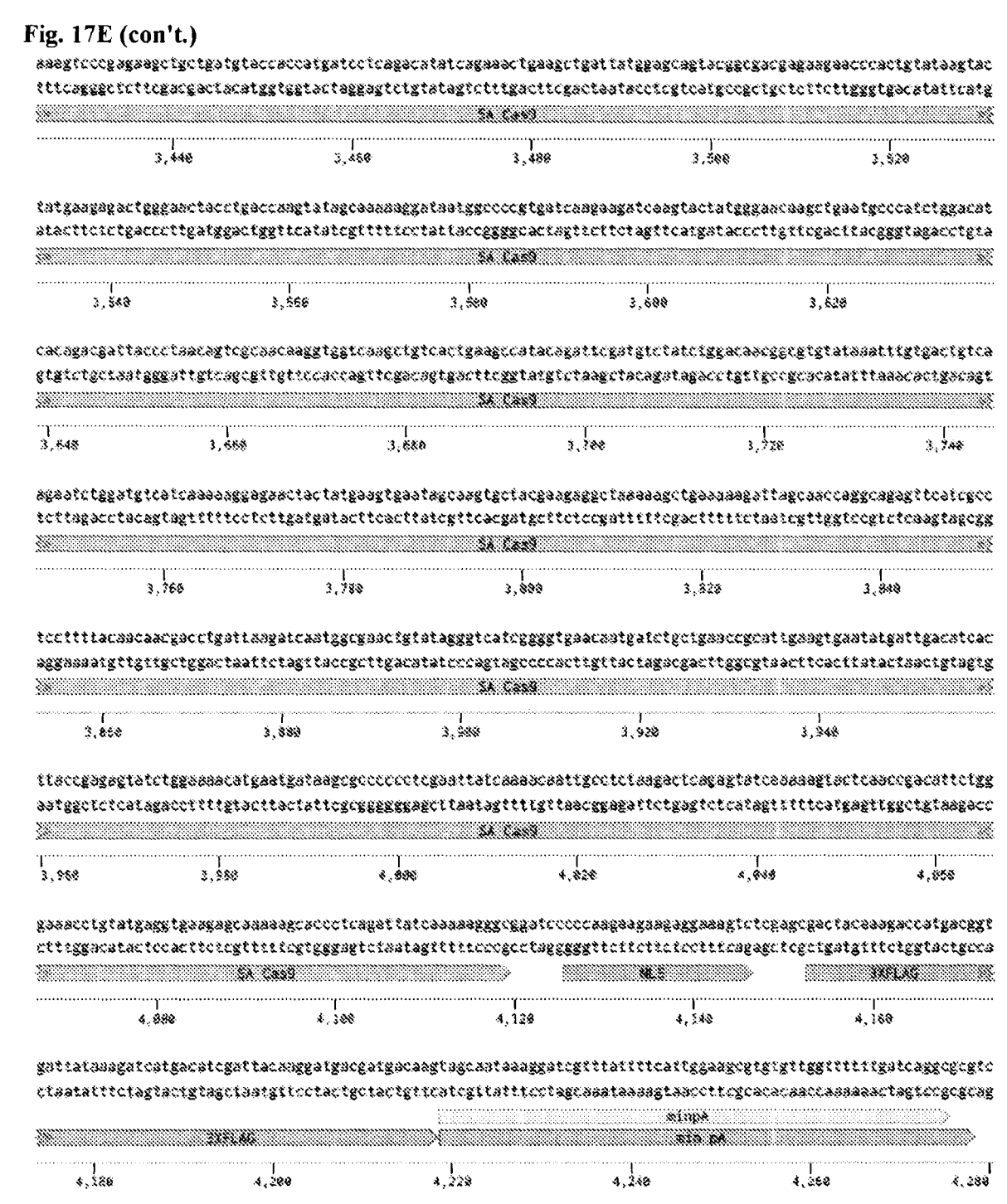
Figure 17E:
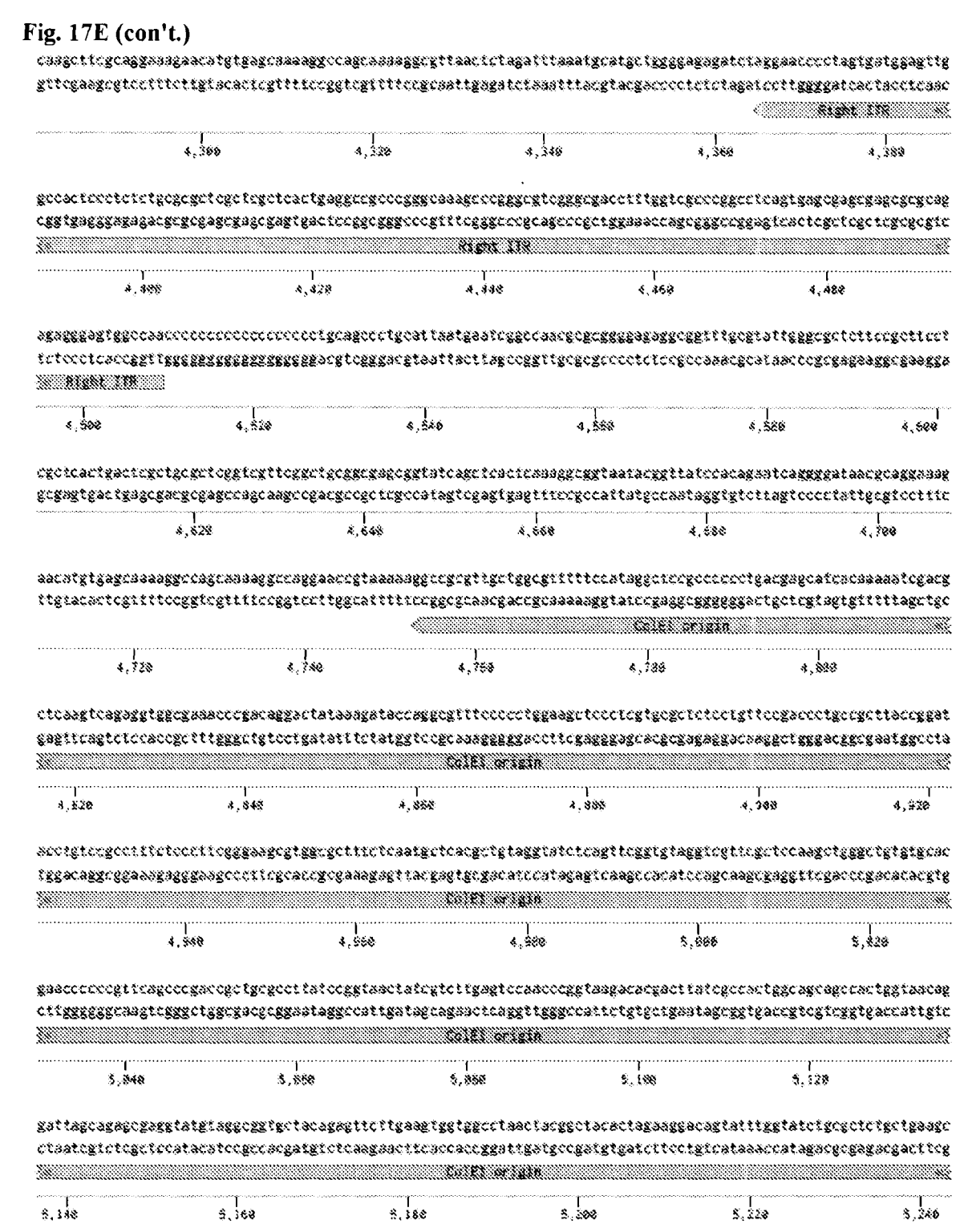
Figure 17E:
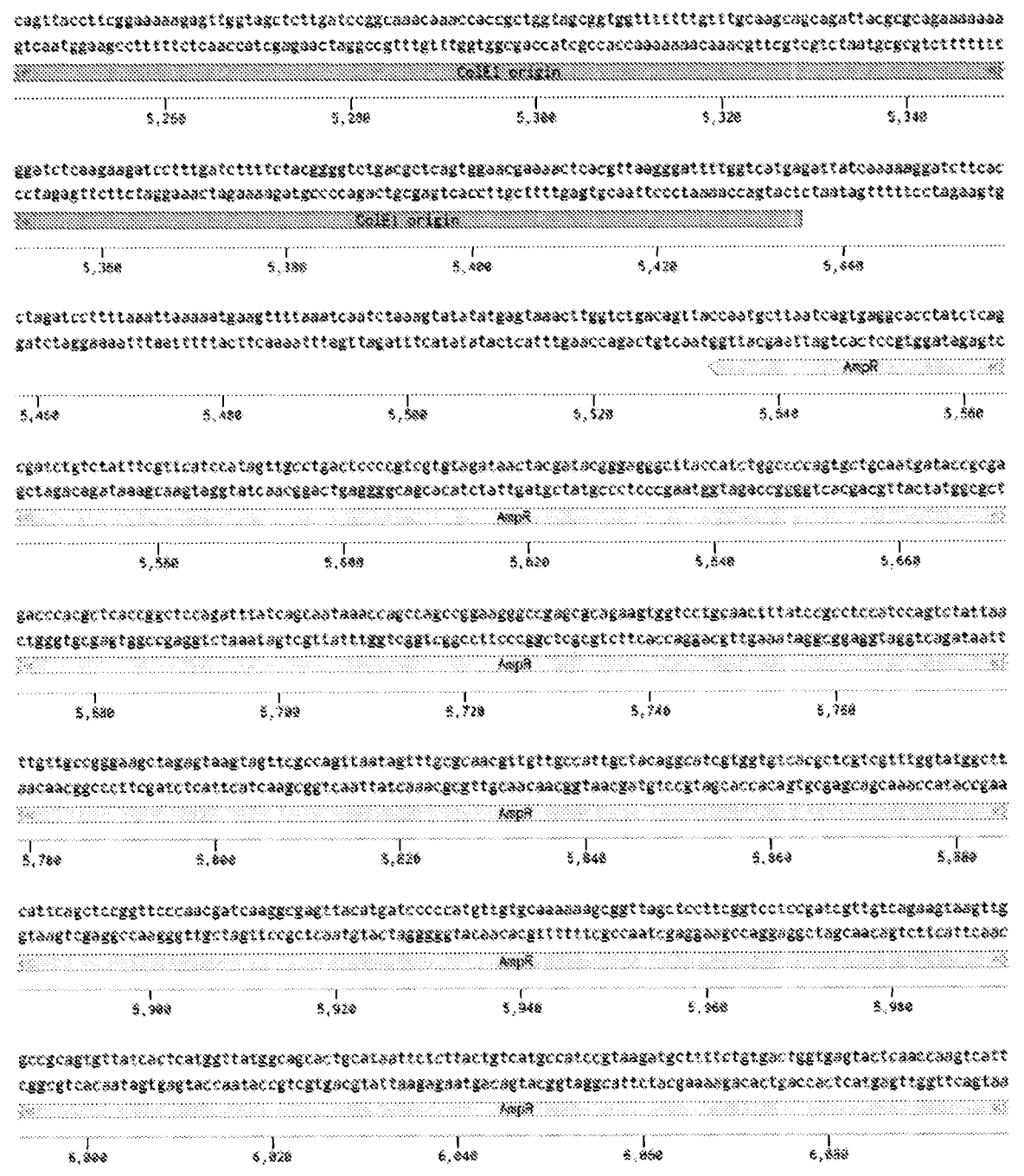
Figure 17E:
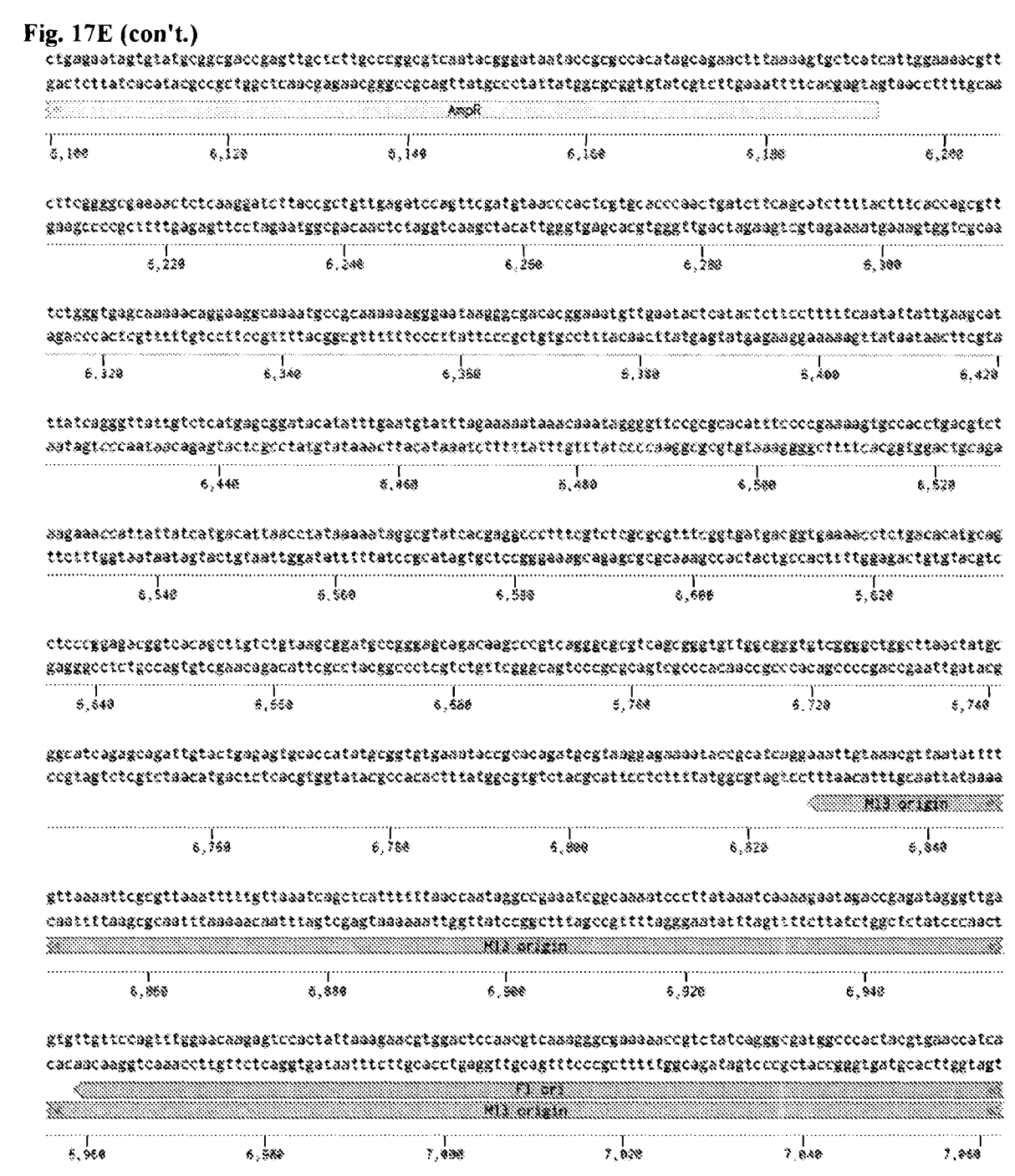
Figure 17E:
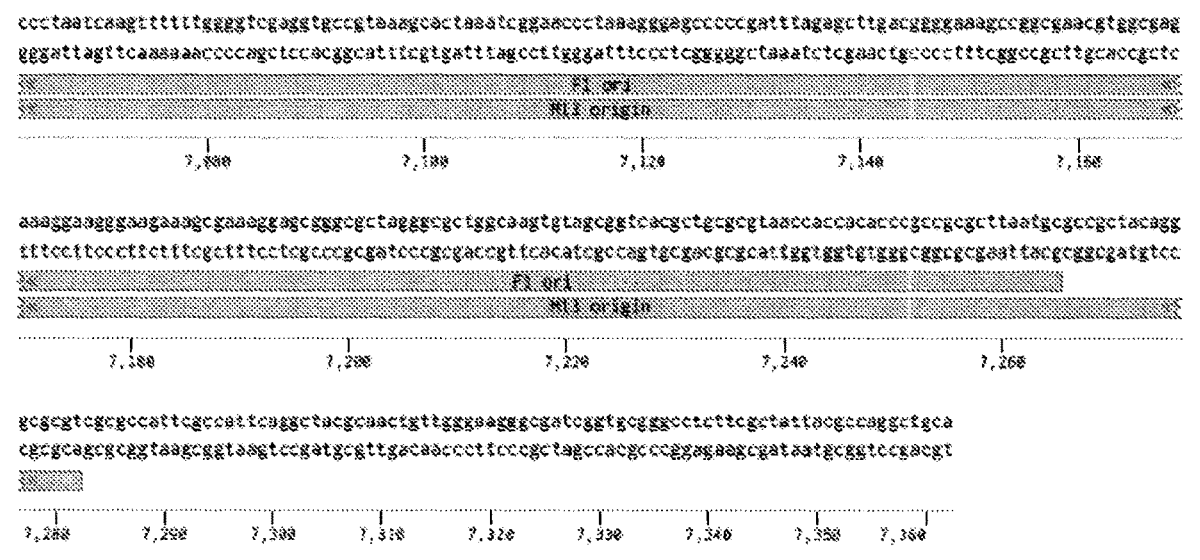
Figure 17F:
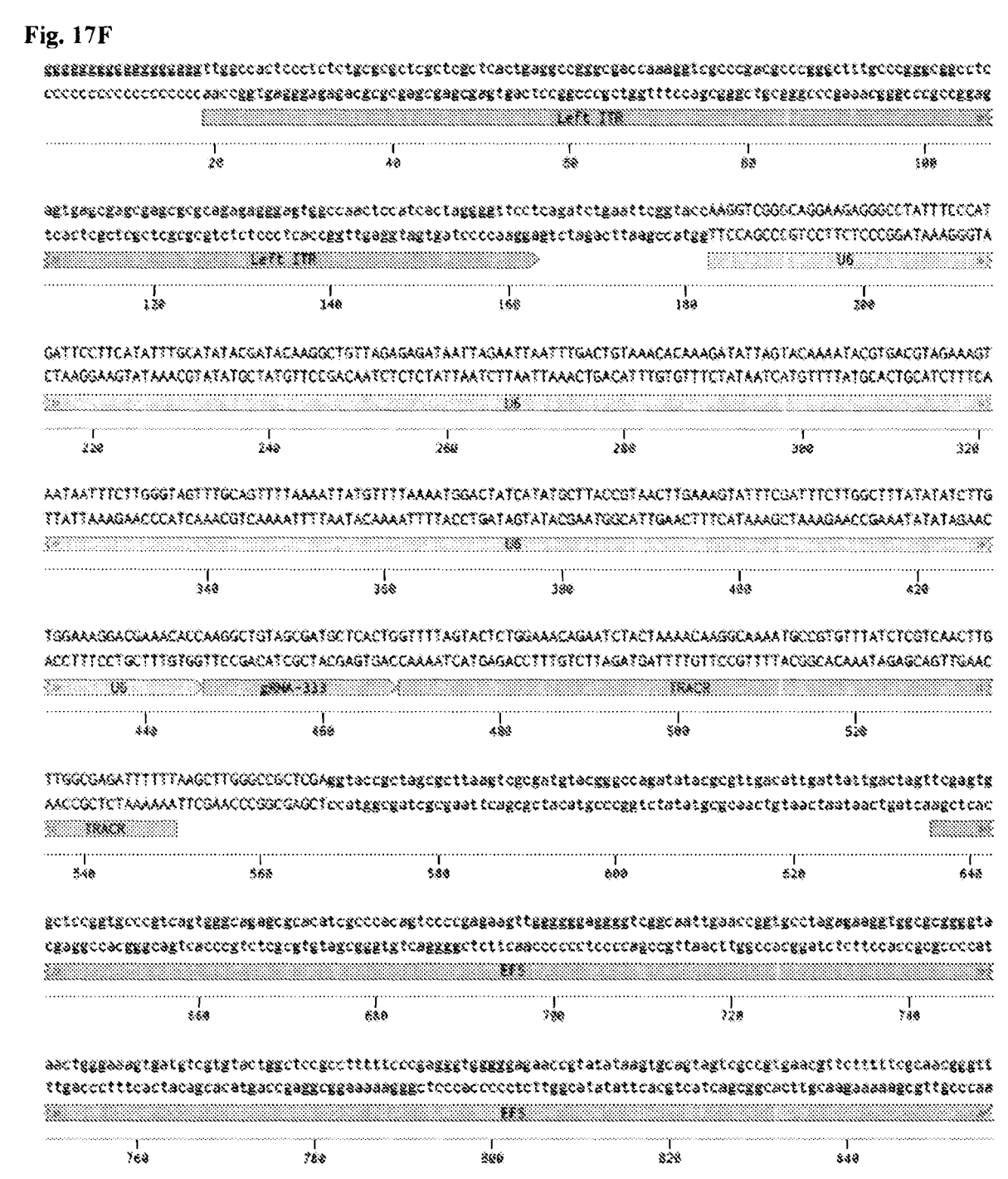
Figure 17F:
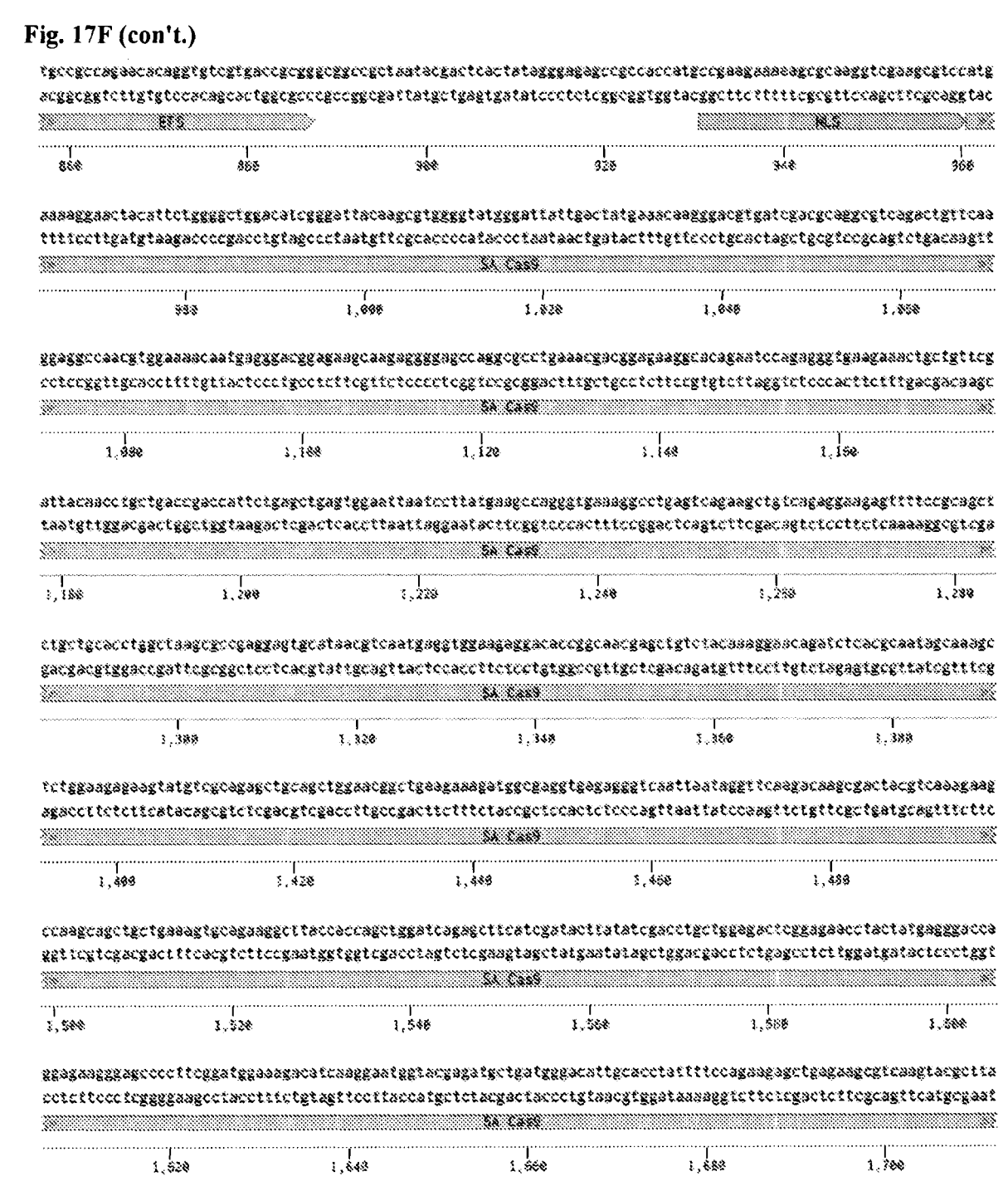
Figure 17F:
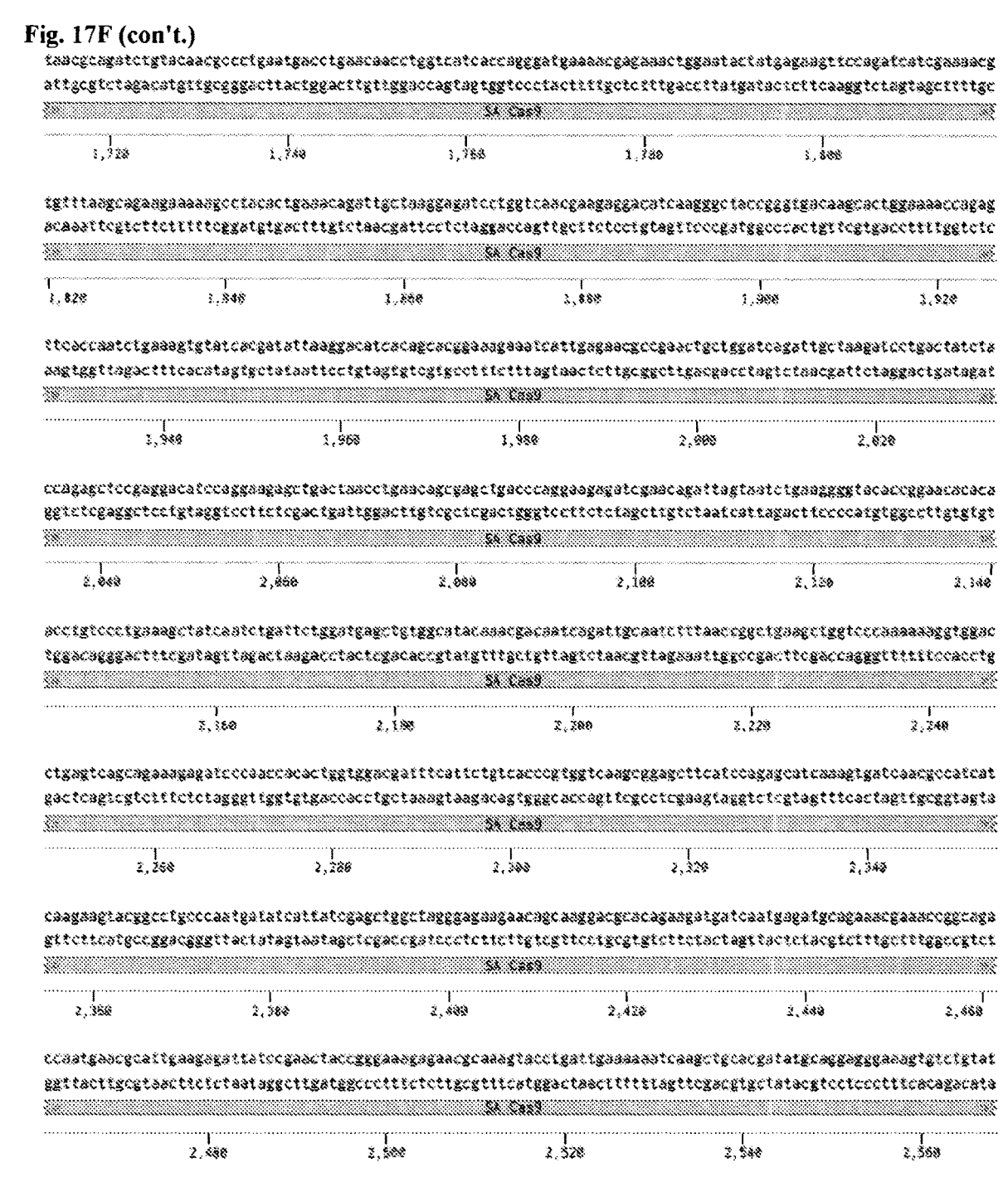
Figure 17F:
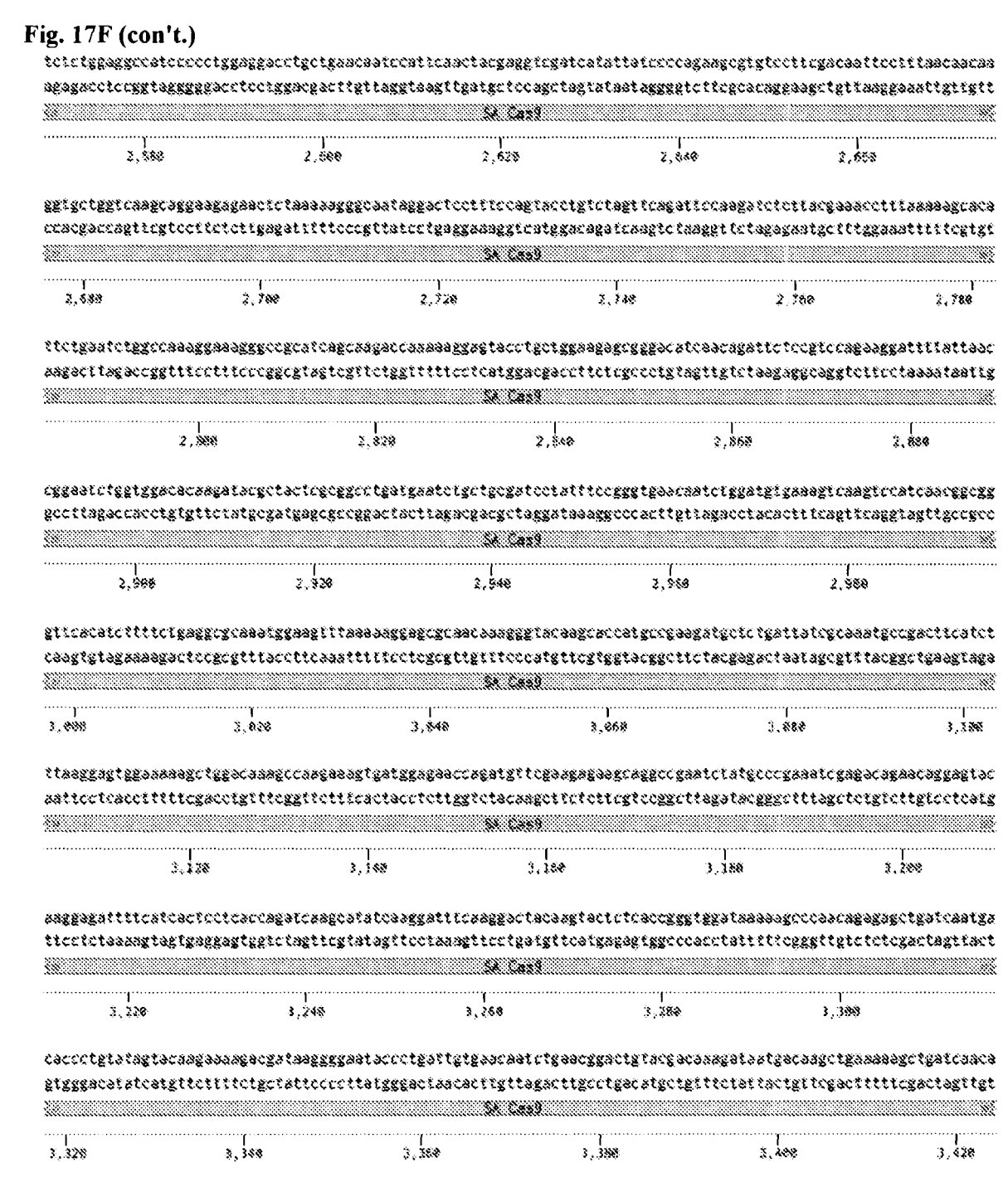
Figure 17F:
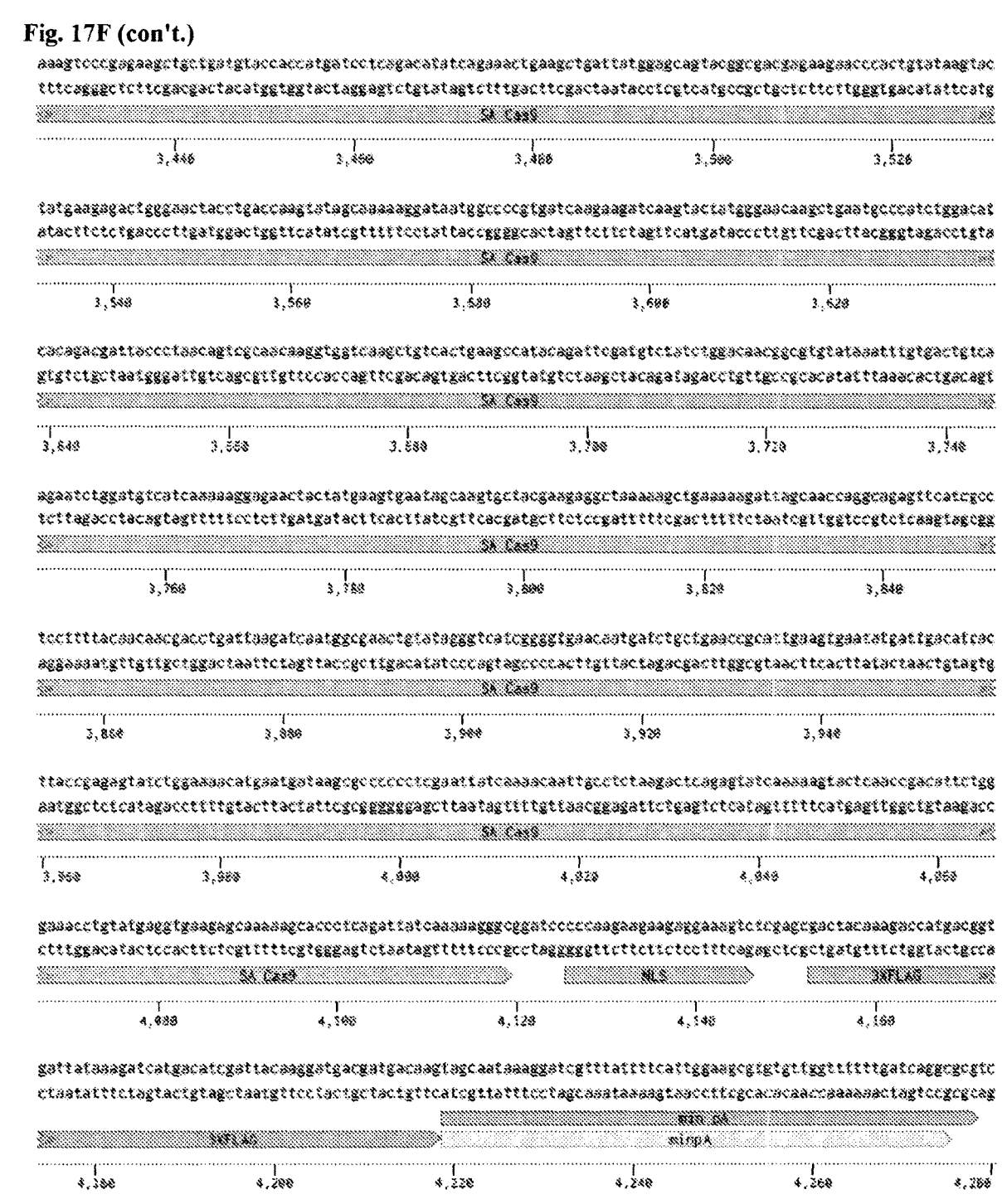
Figure 17F:
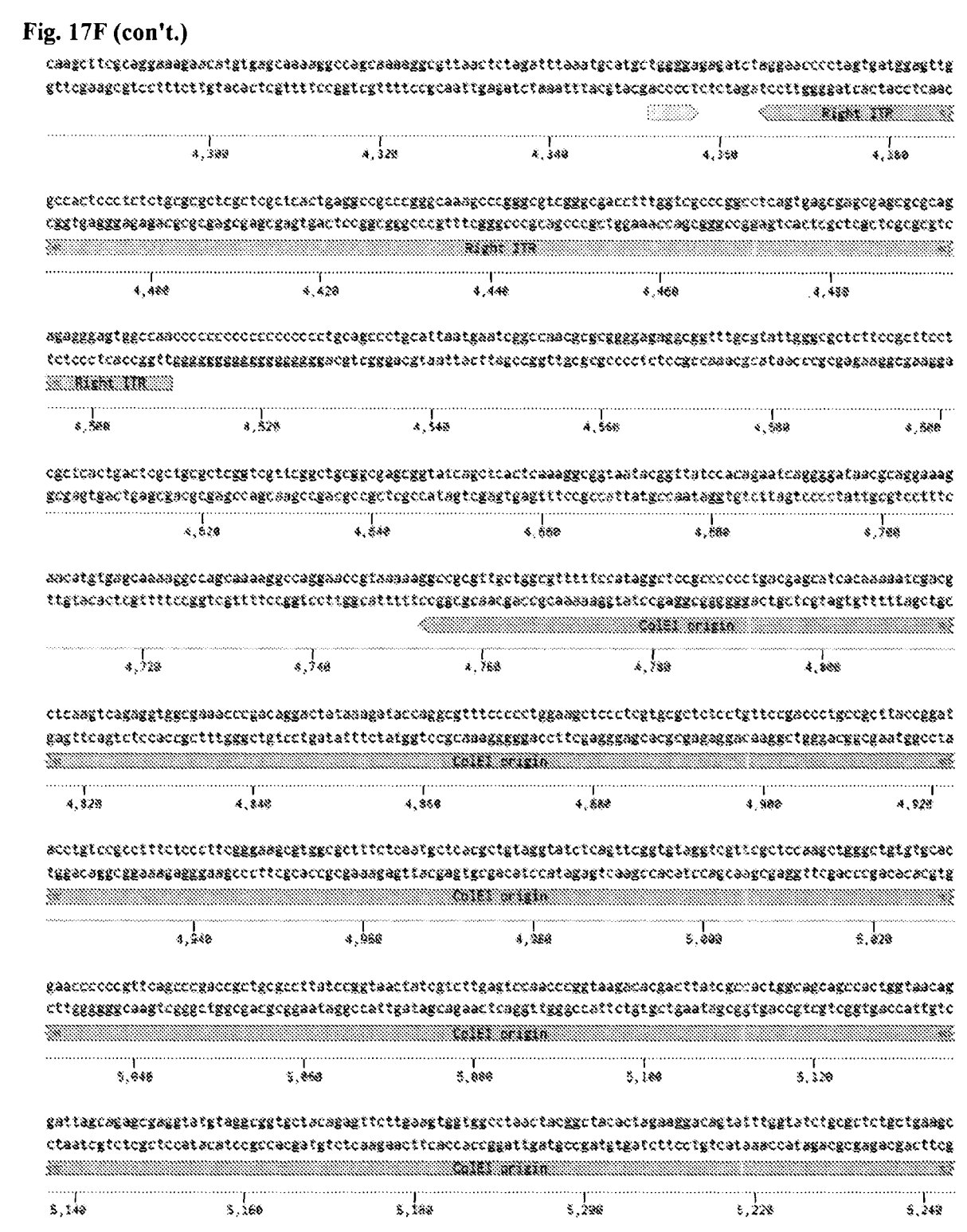
Figure 17F:
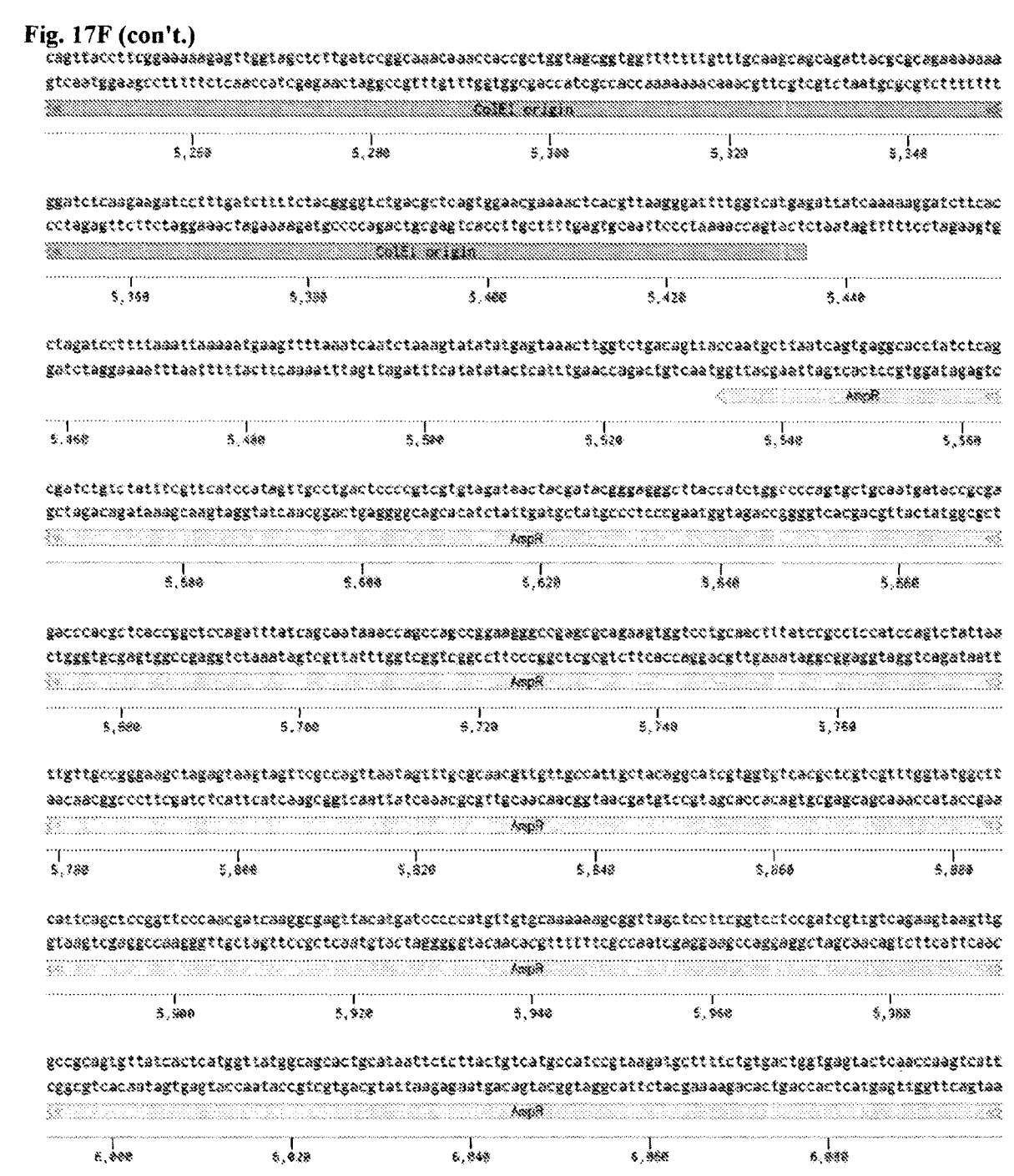
Figure 17F:
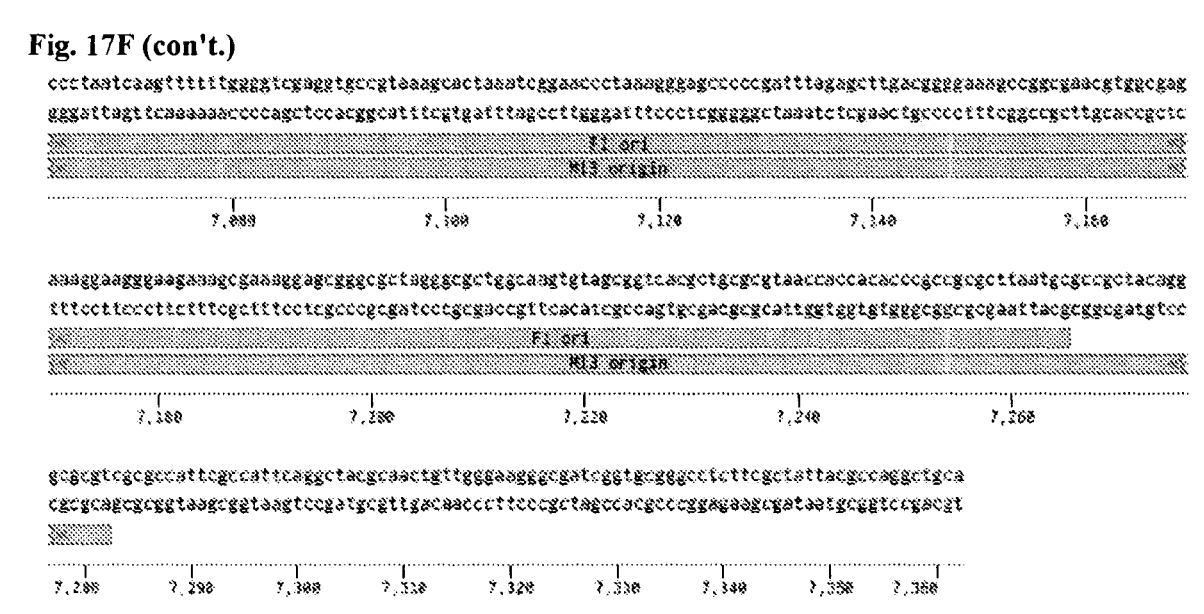
Figure 17G:
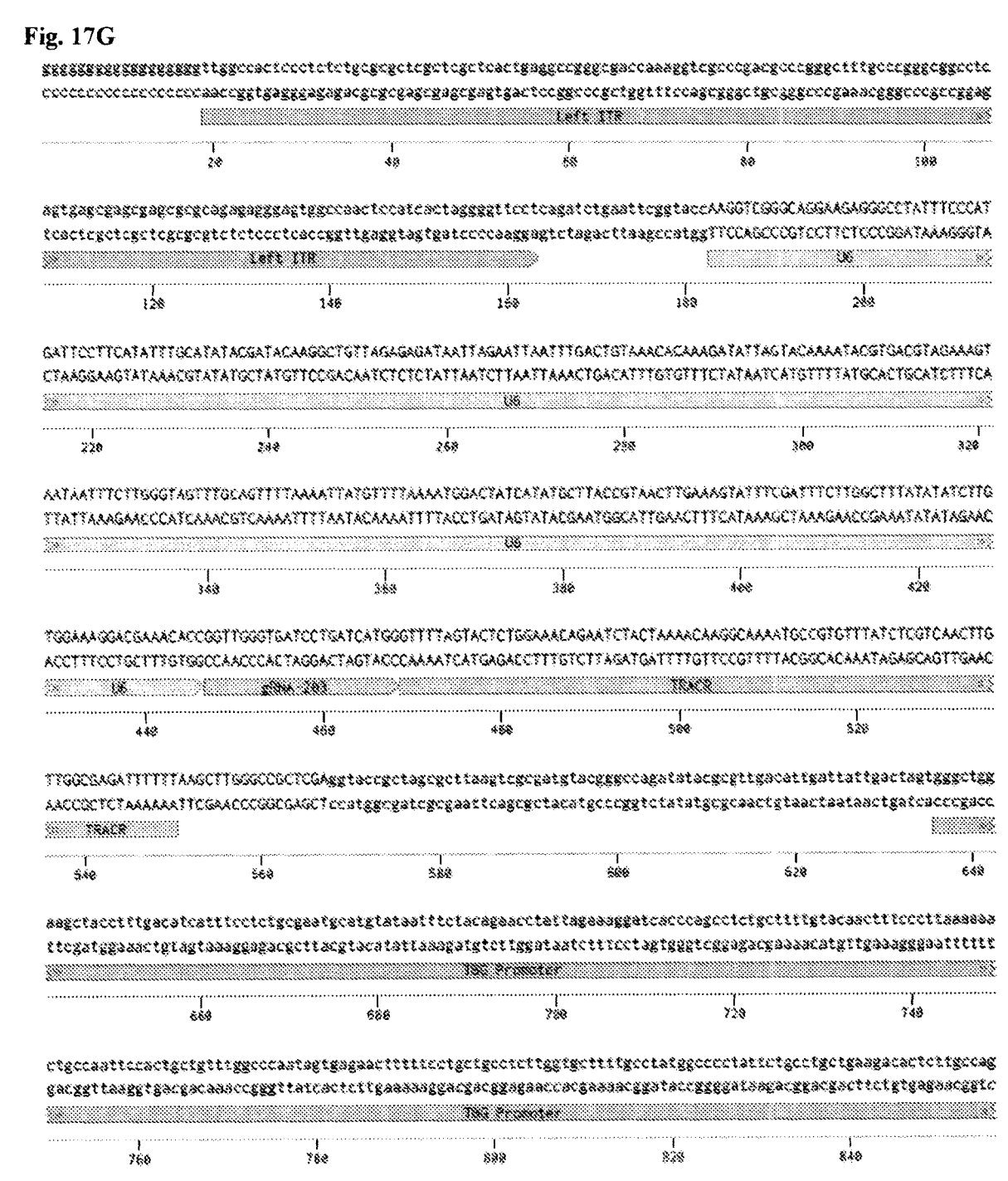
Figure 17G:
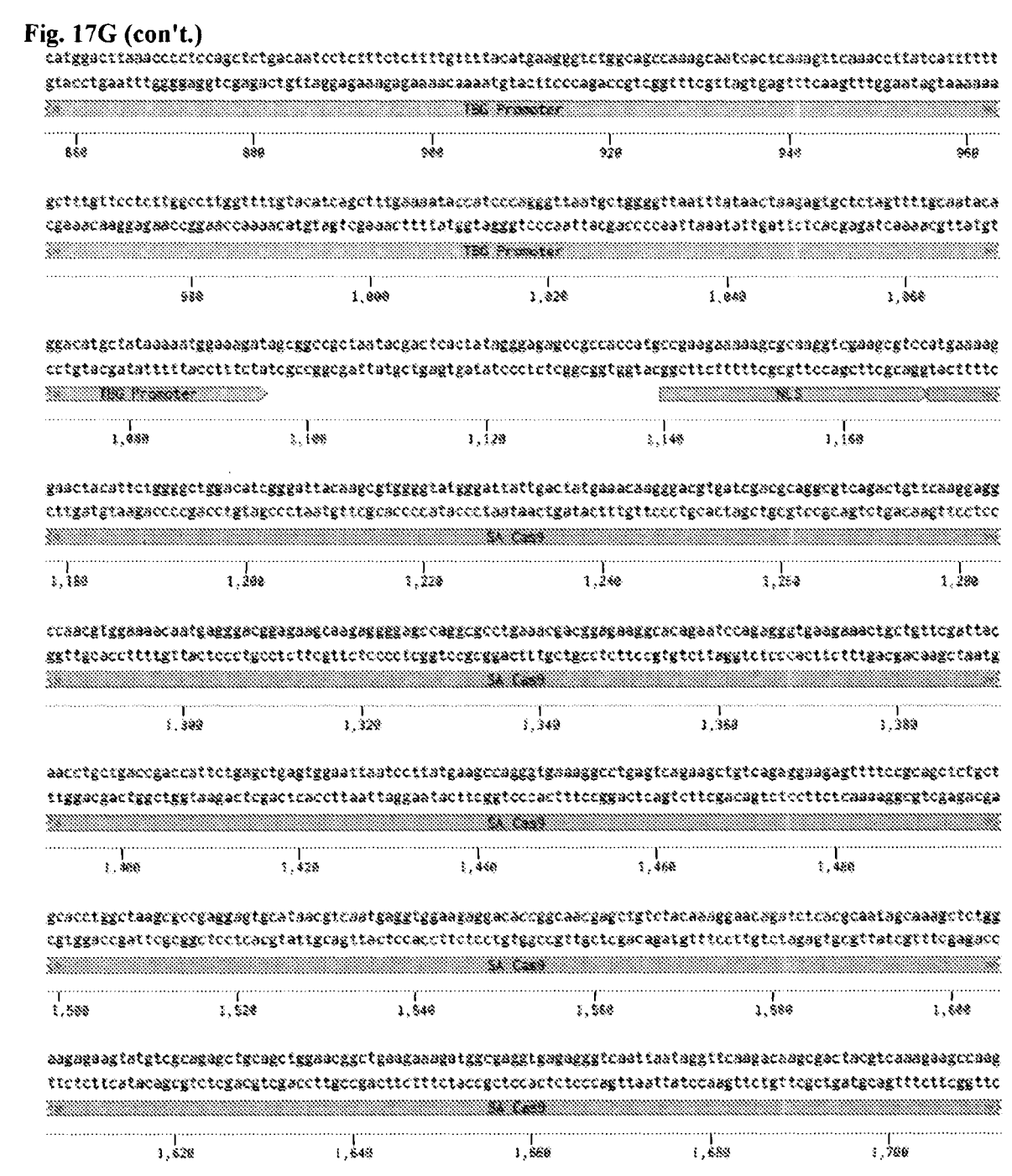
Figure 17G:
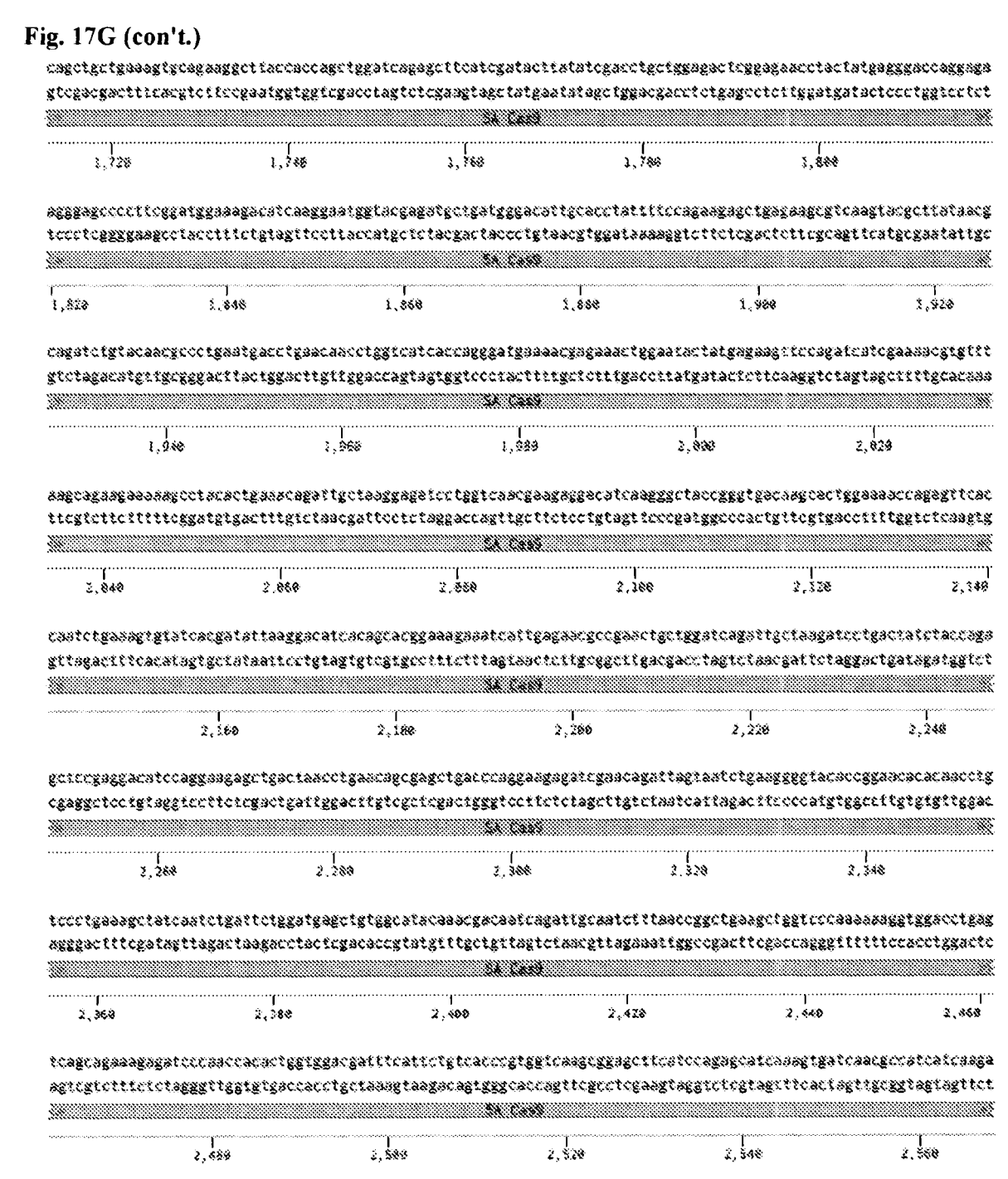
Figure 17G:
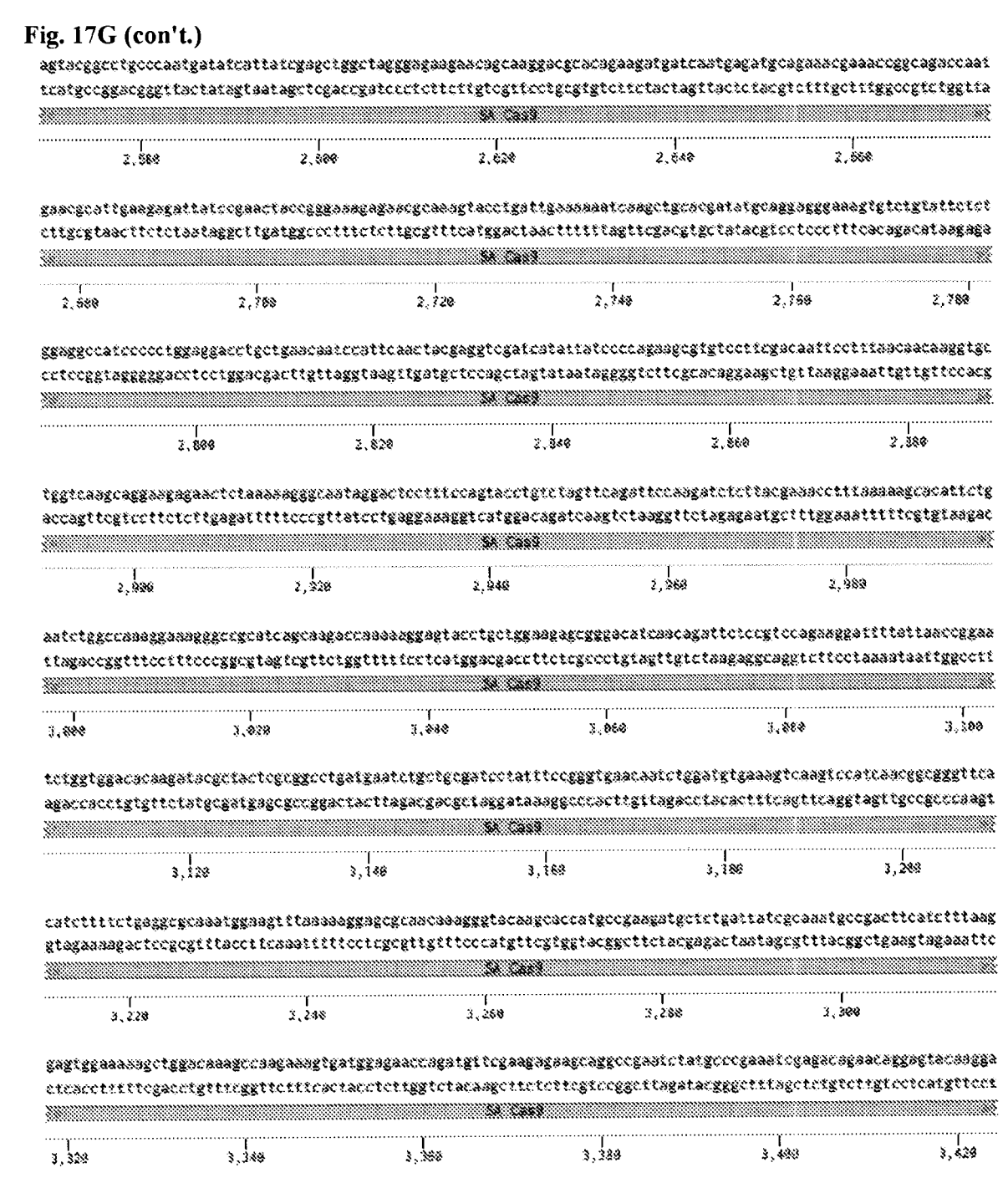
Figure 17G:
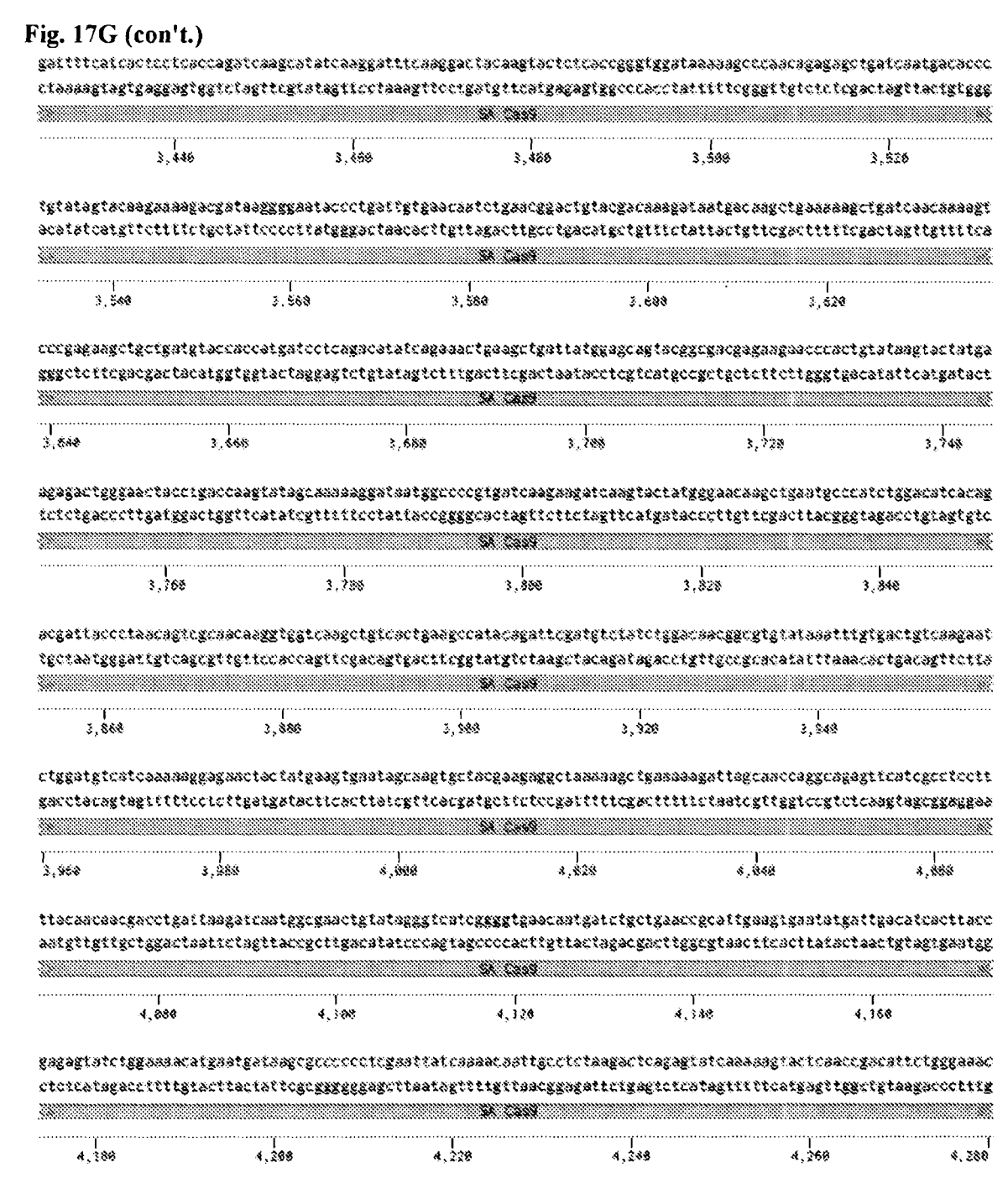
Figure 17G:
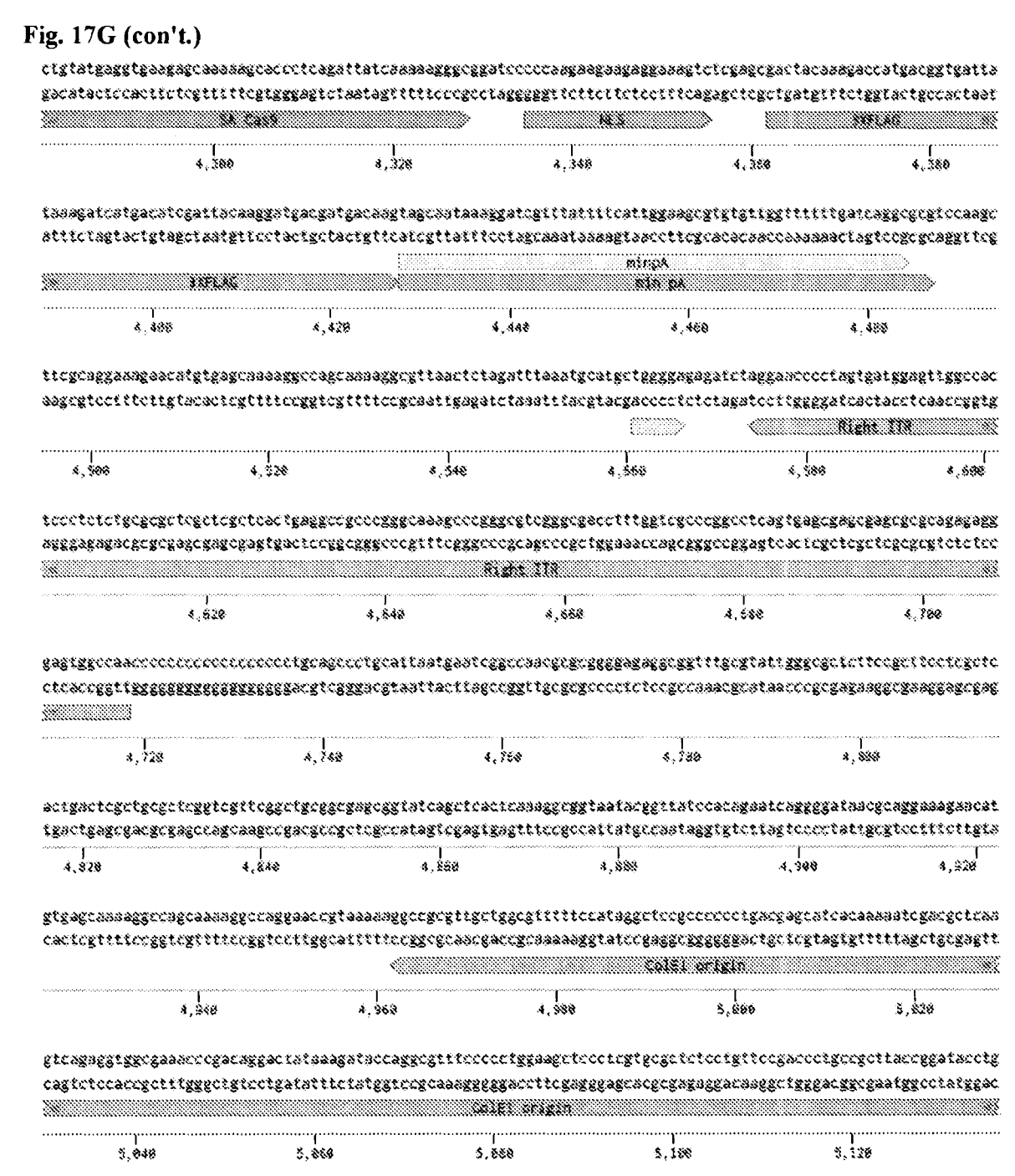
Figure 17G:
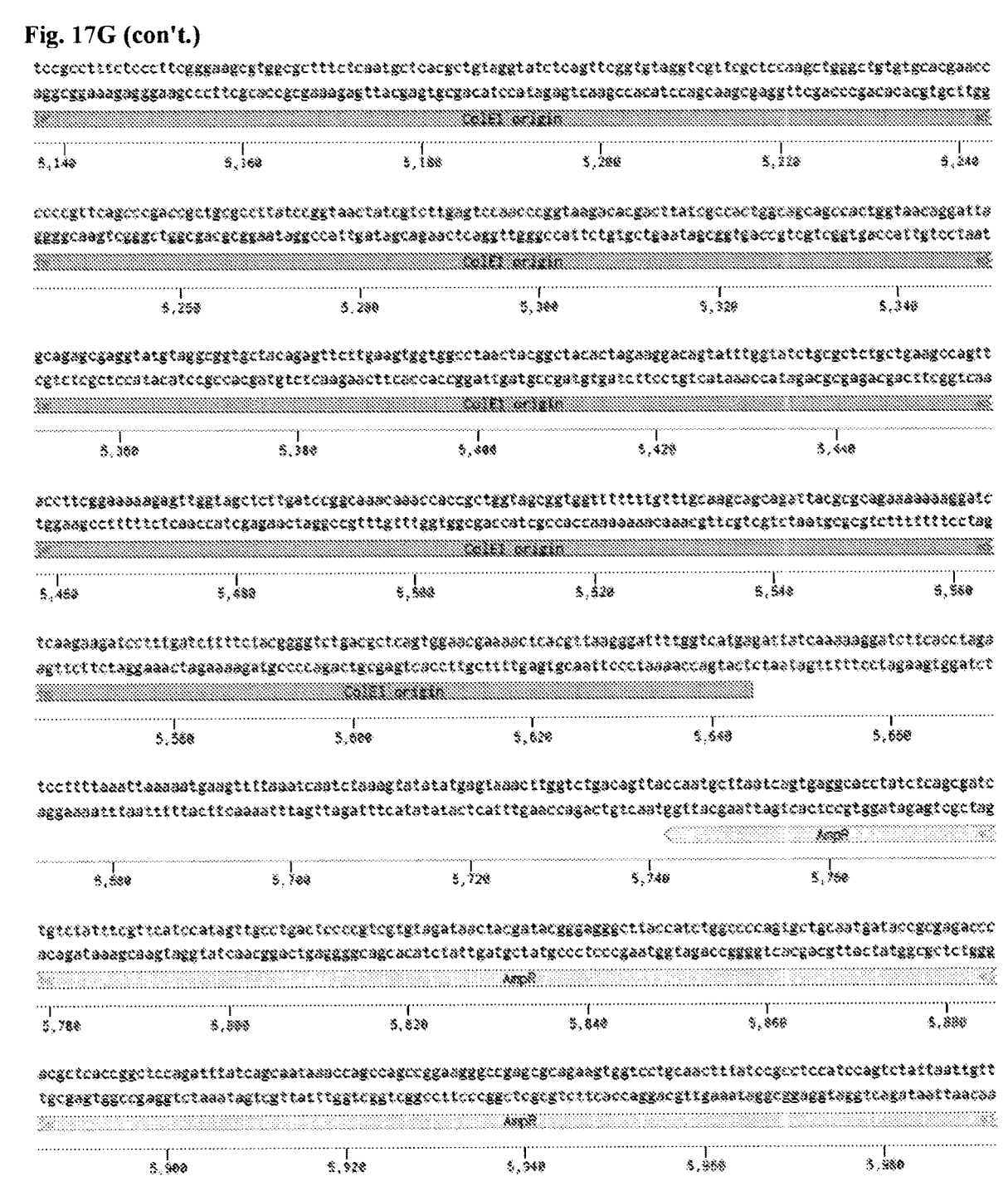
Figure 17G:
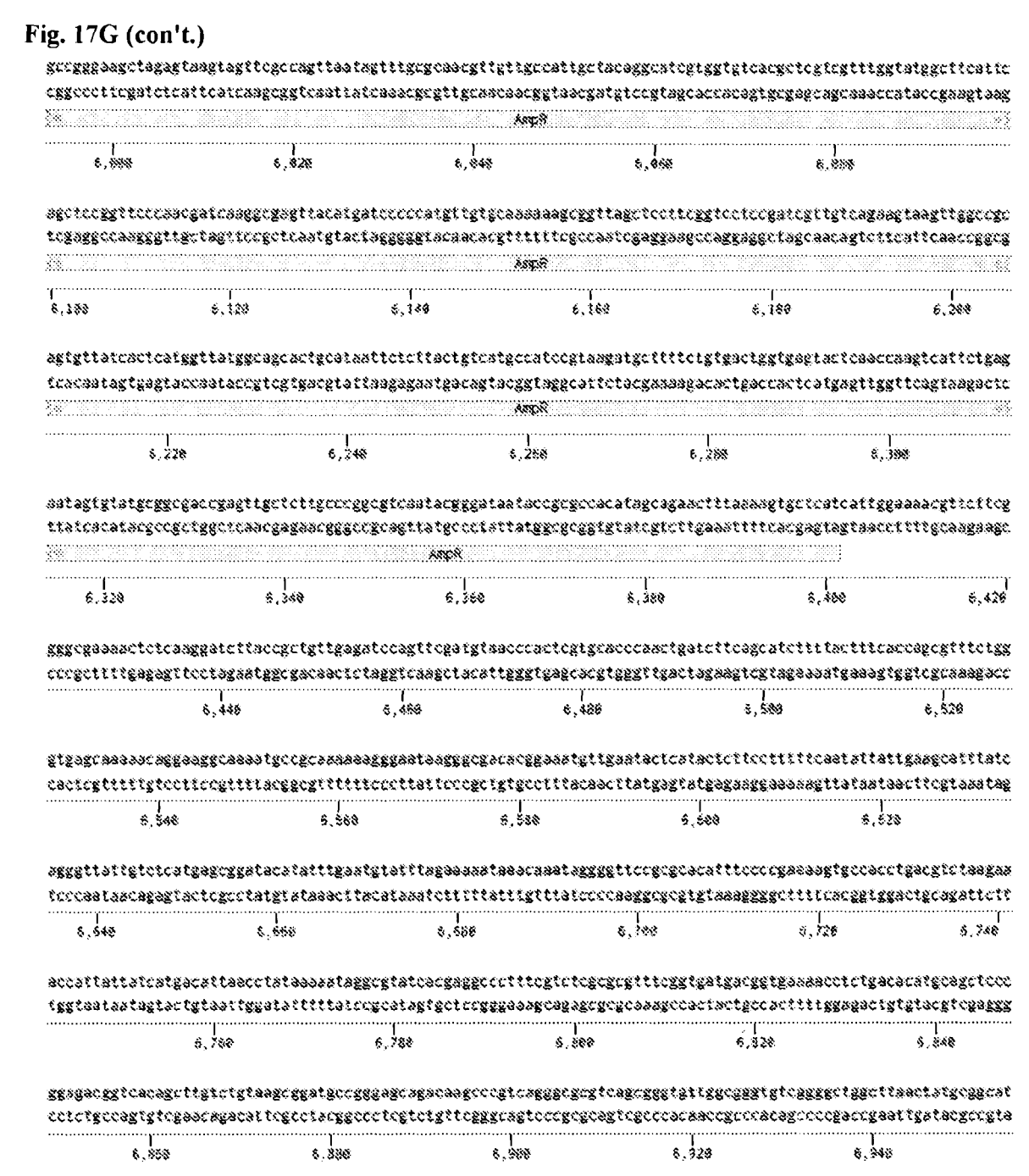
Figure 17G:
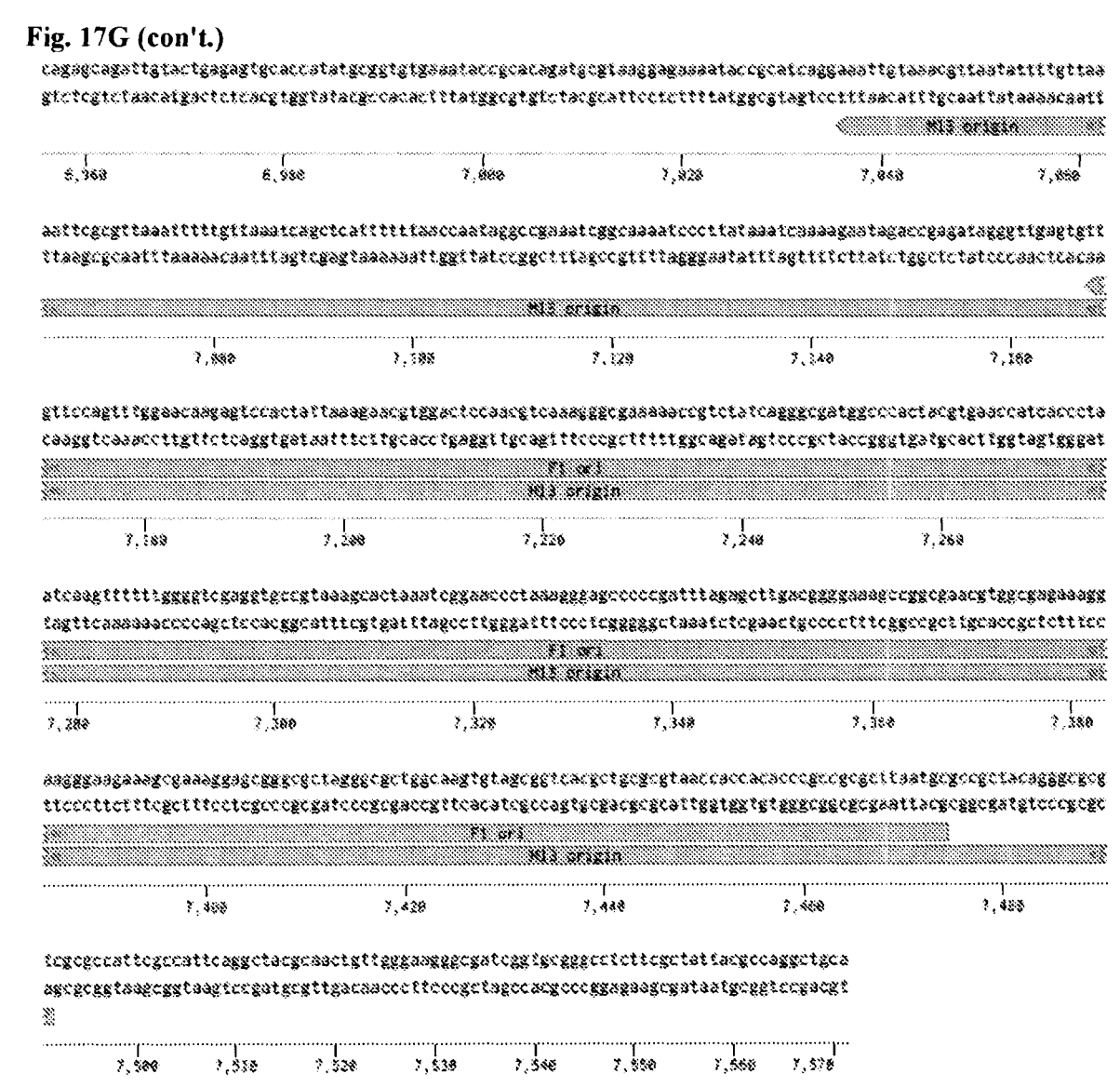
Figure 17H:
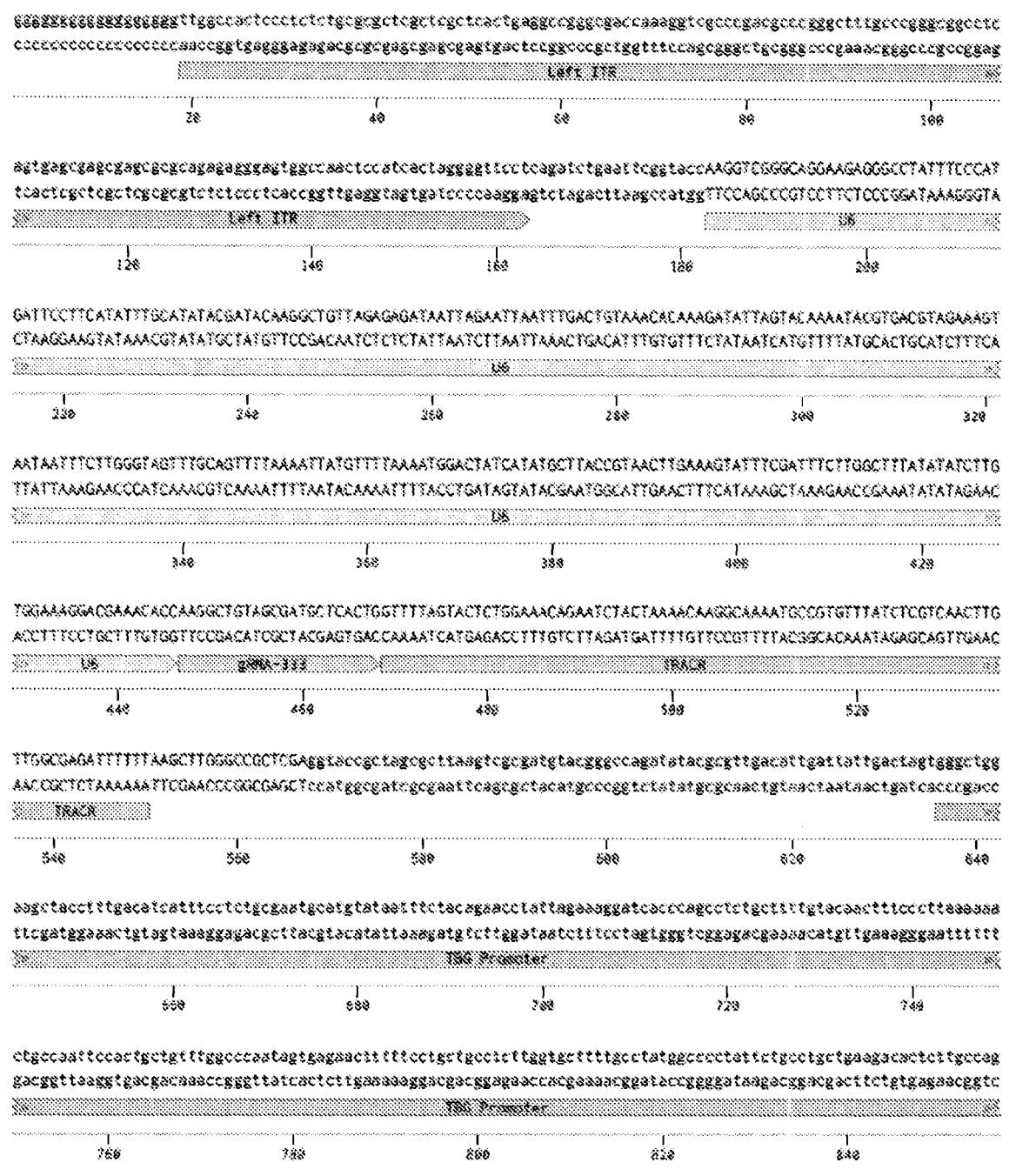
Figure 17H:
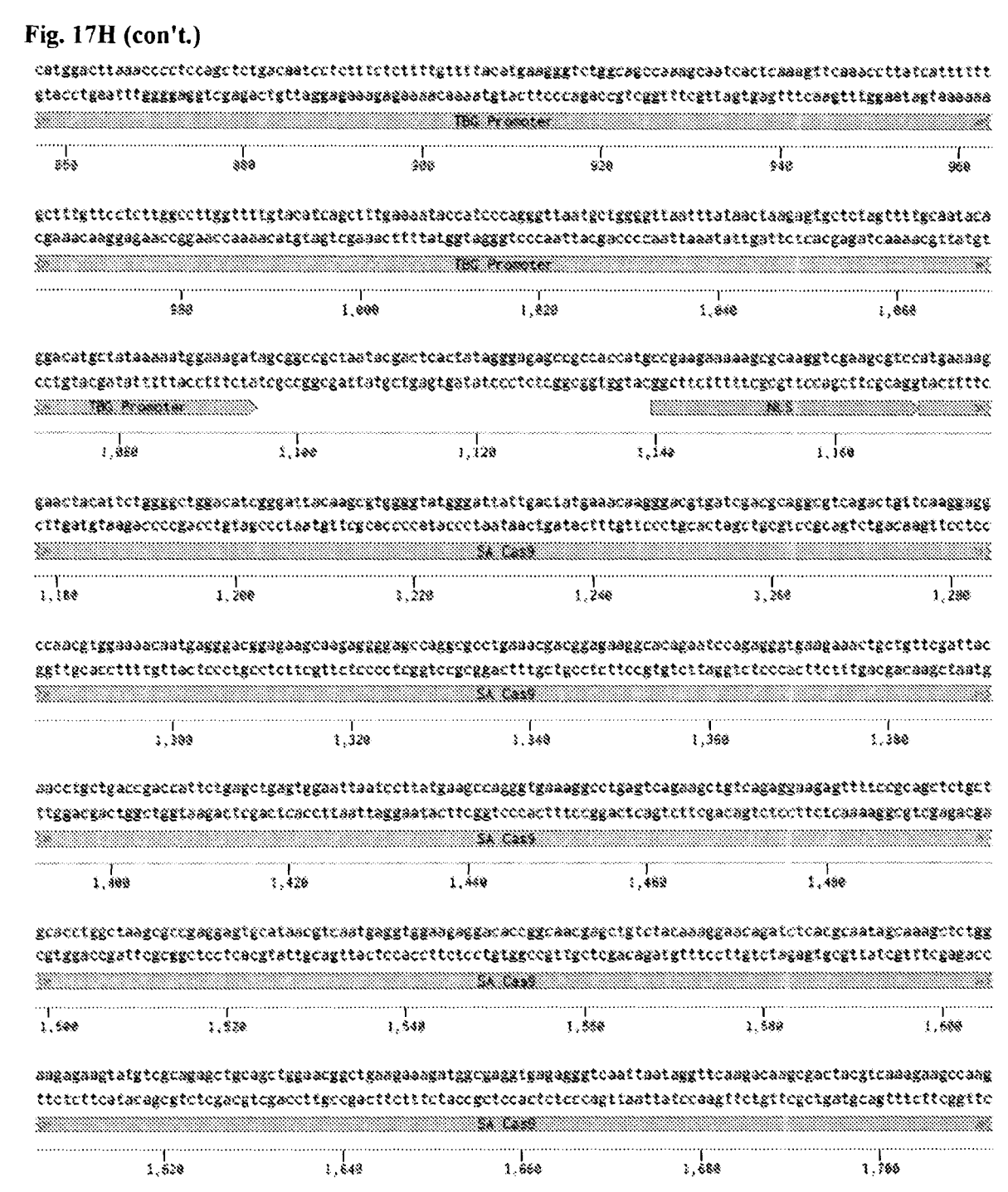
Figure 17H:
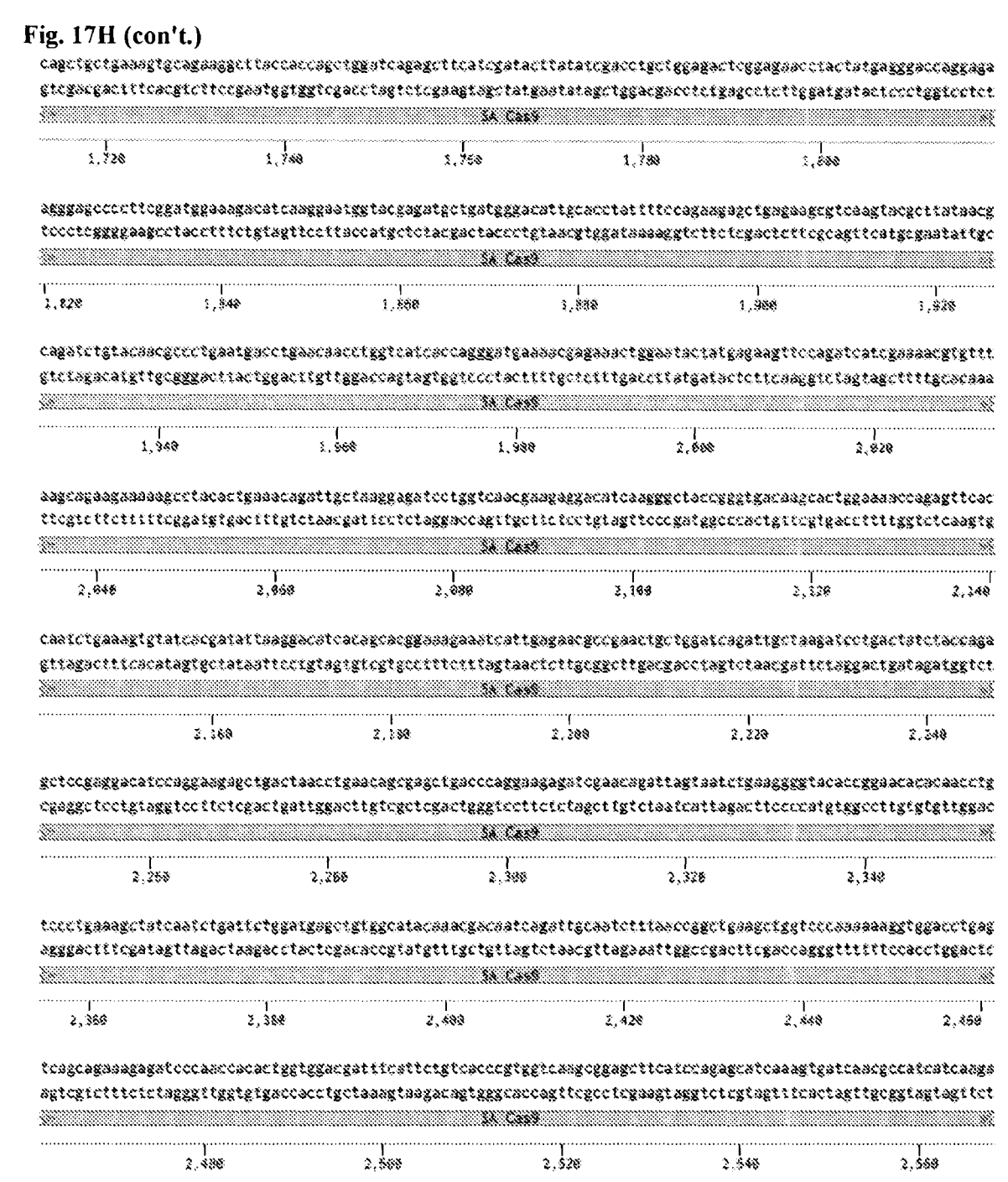
Figure 17H:
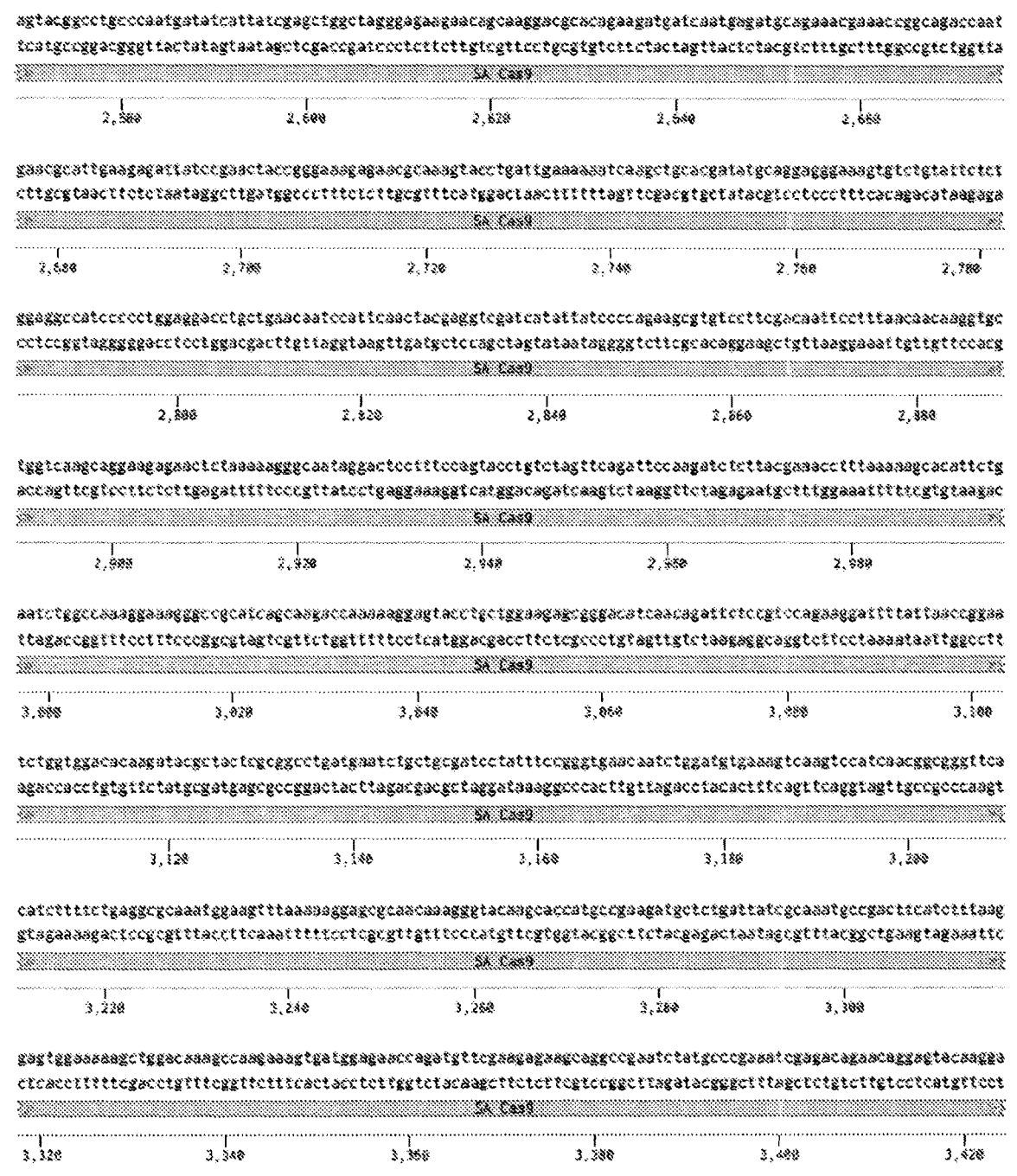
Figure 17H:
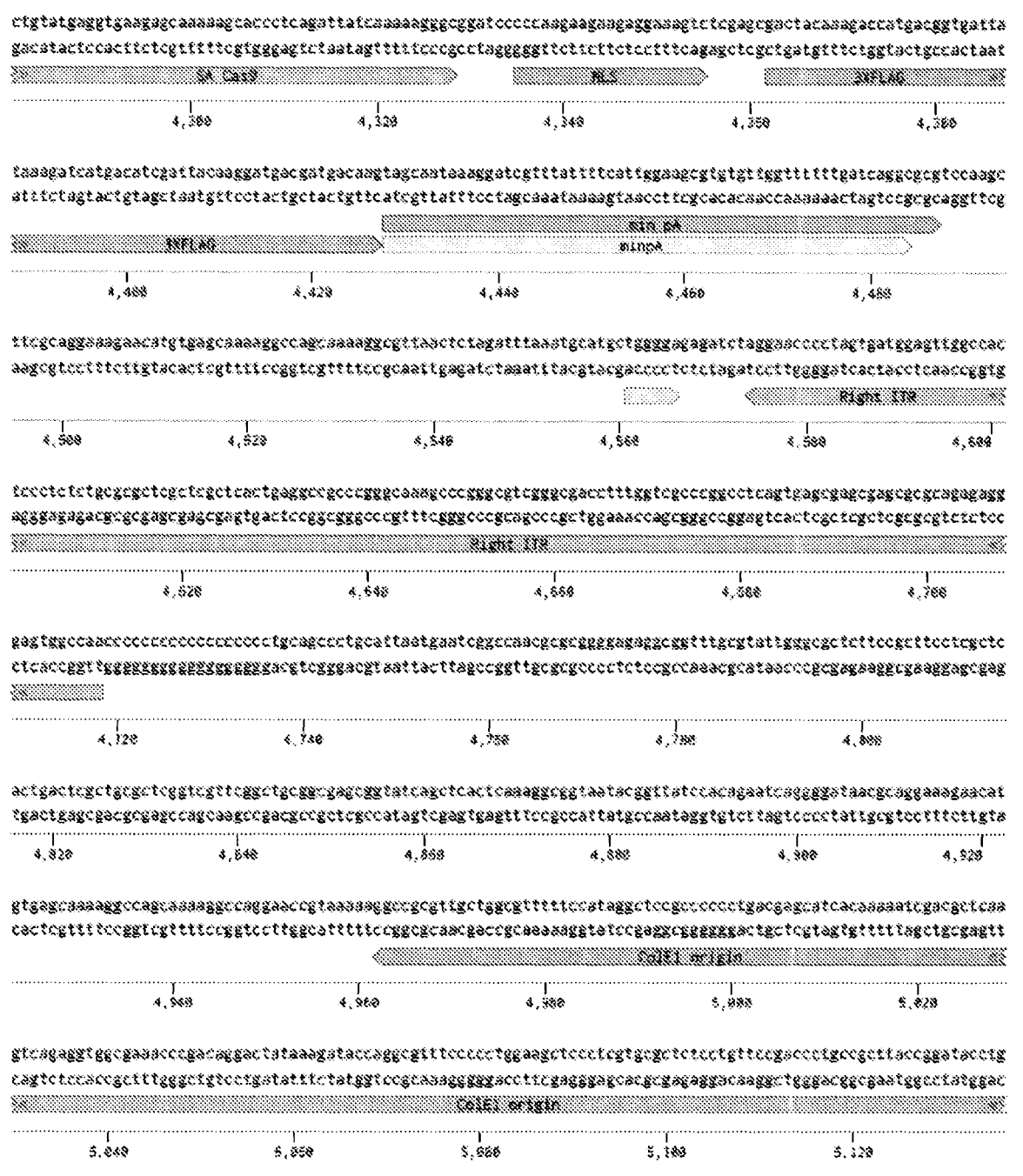
Figure 17H:
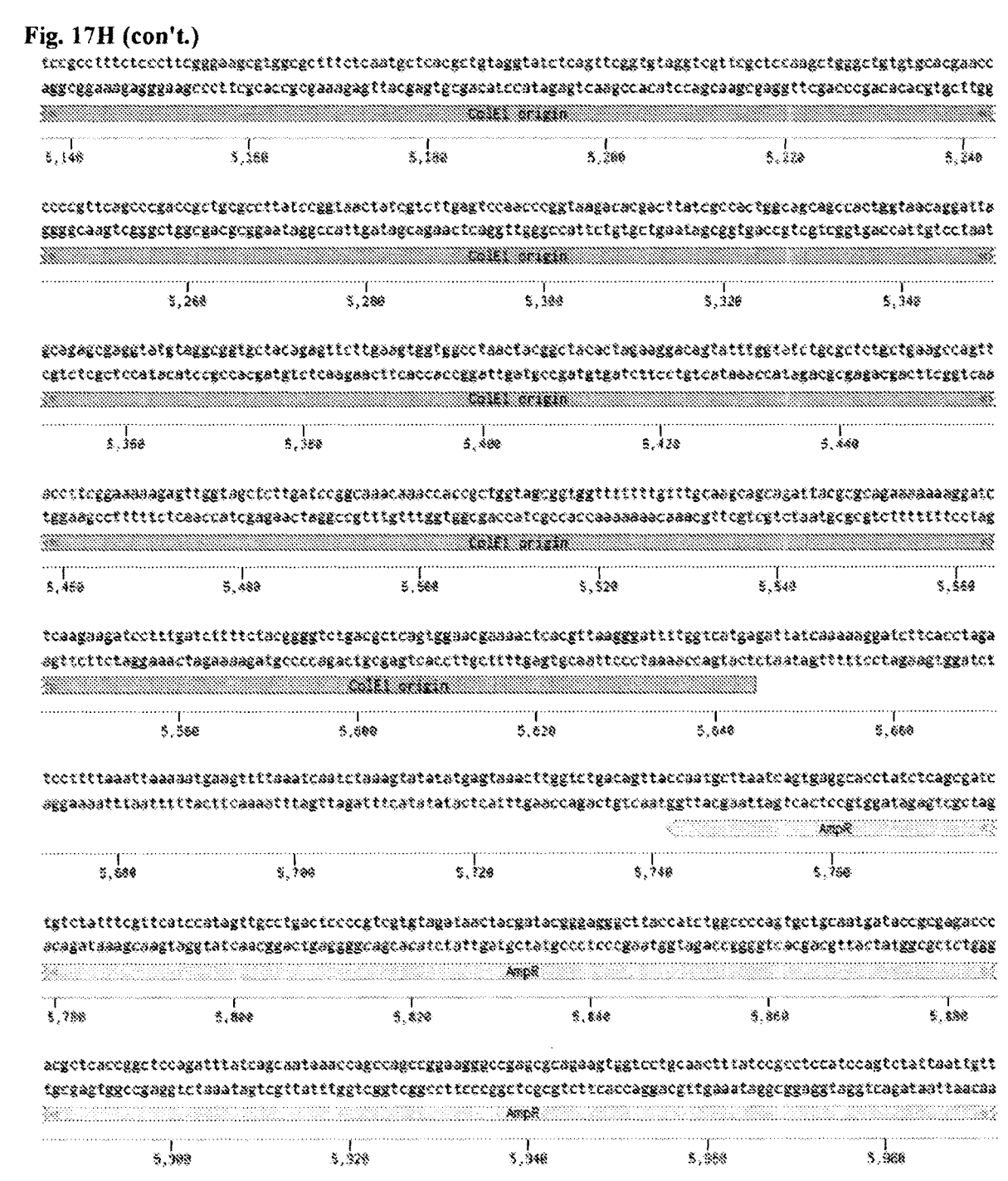
Figure 17H:
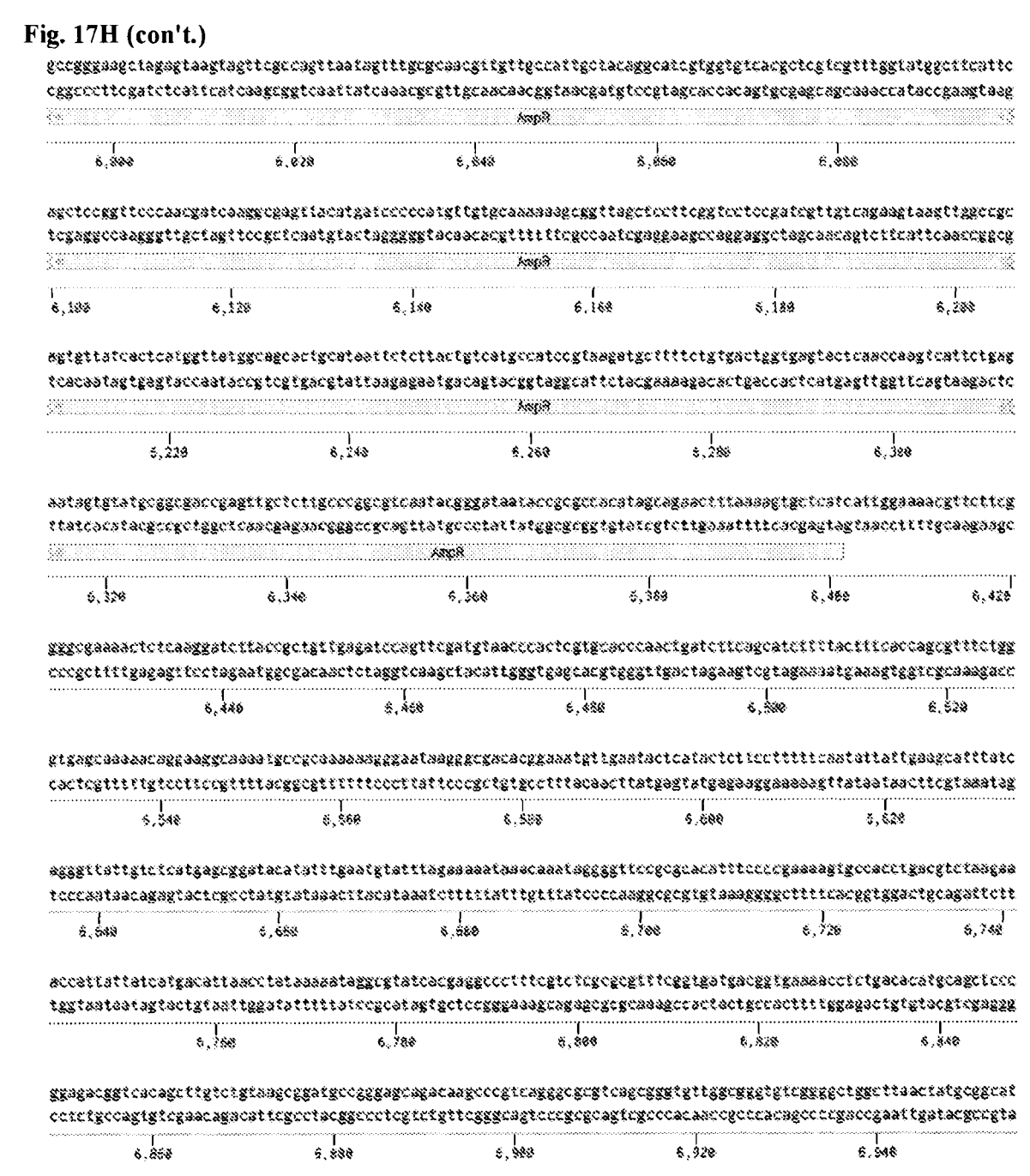
Figure 17H:
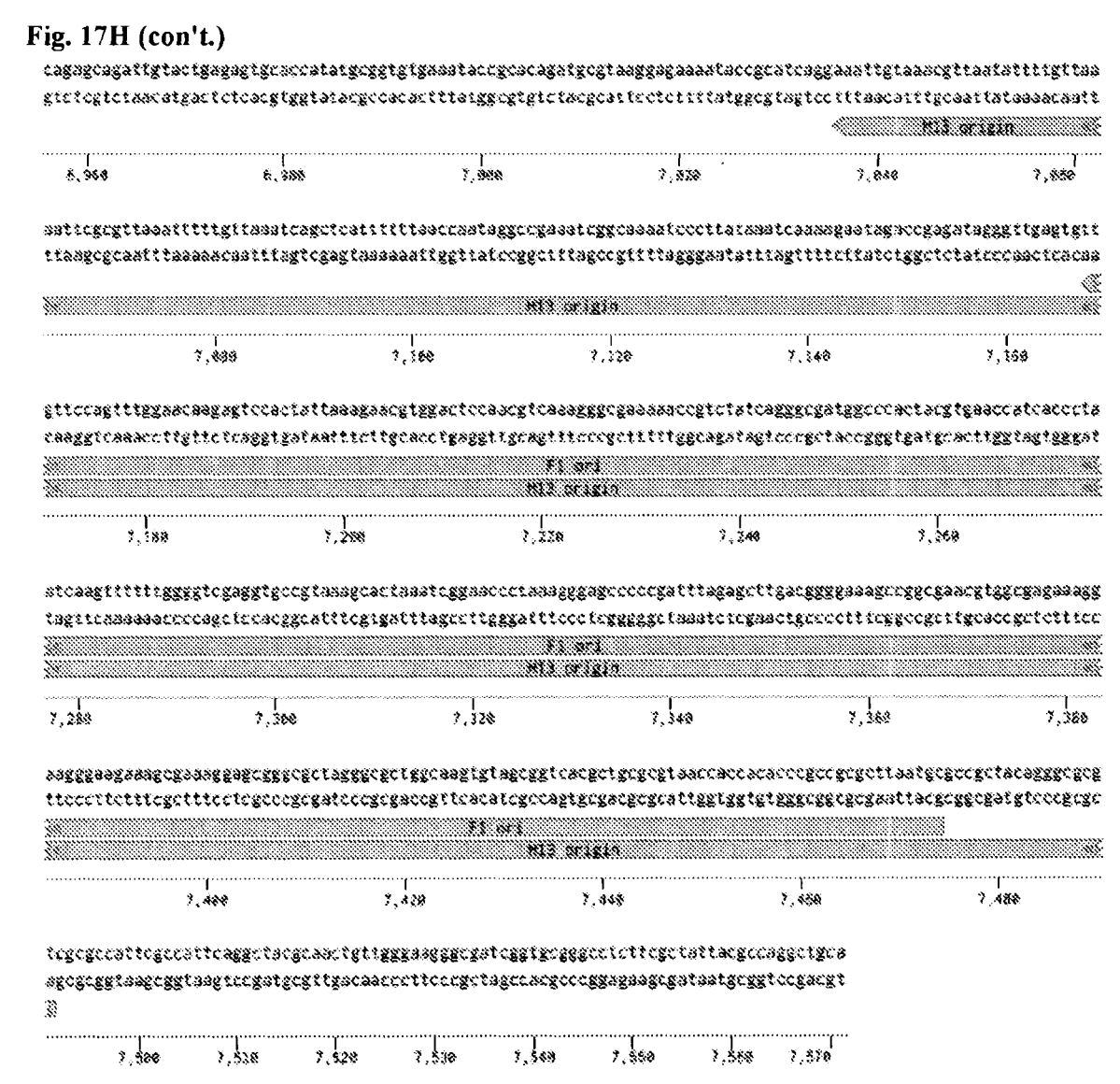
Figure 17I:
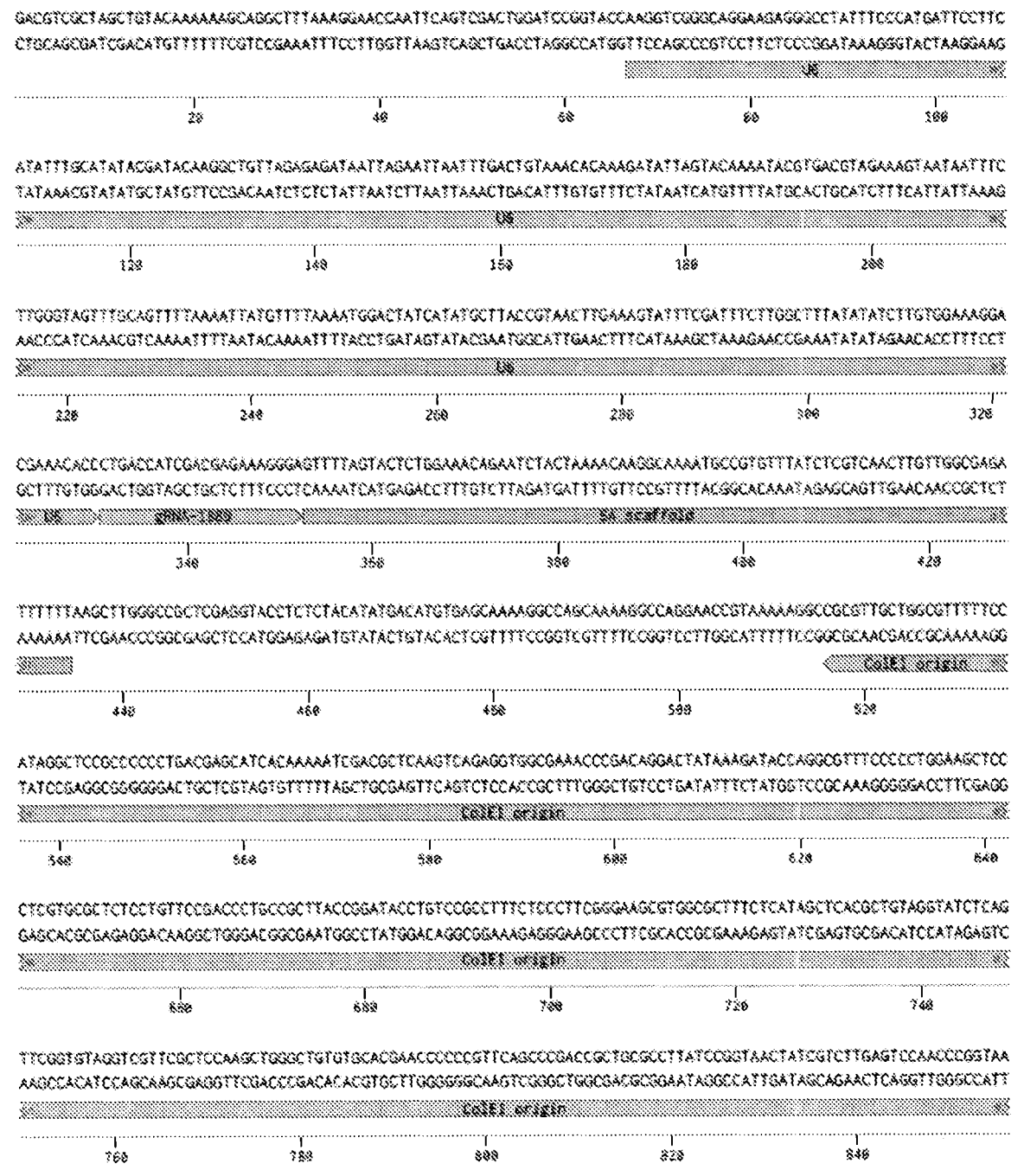
Figure 17I:
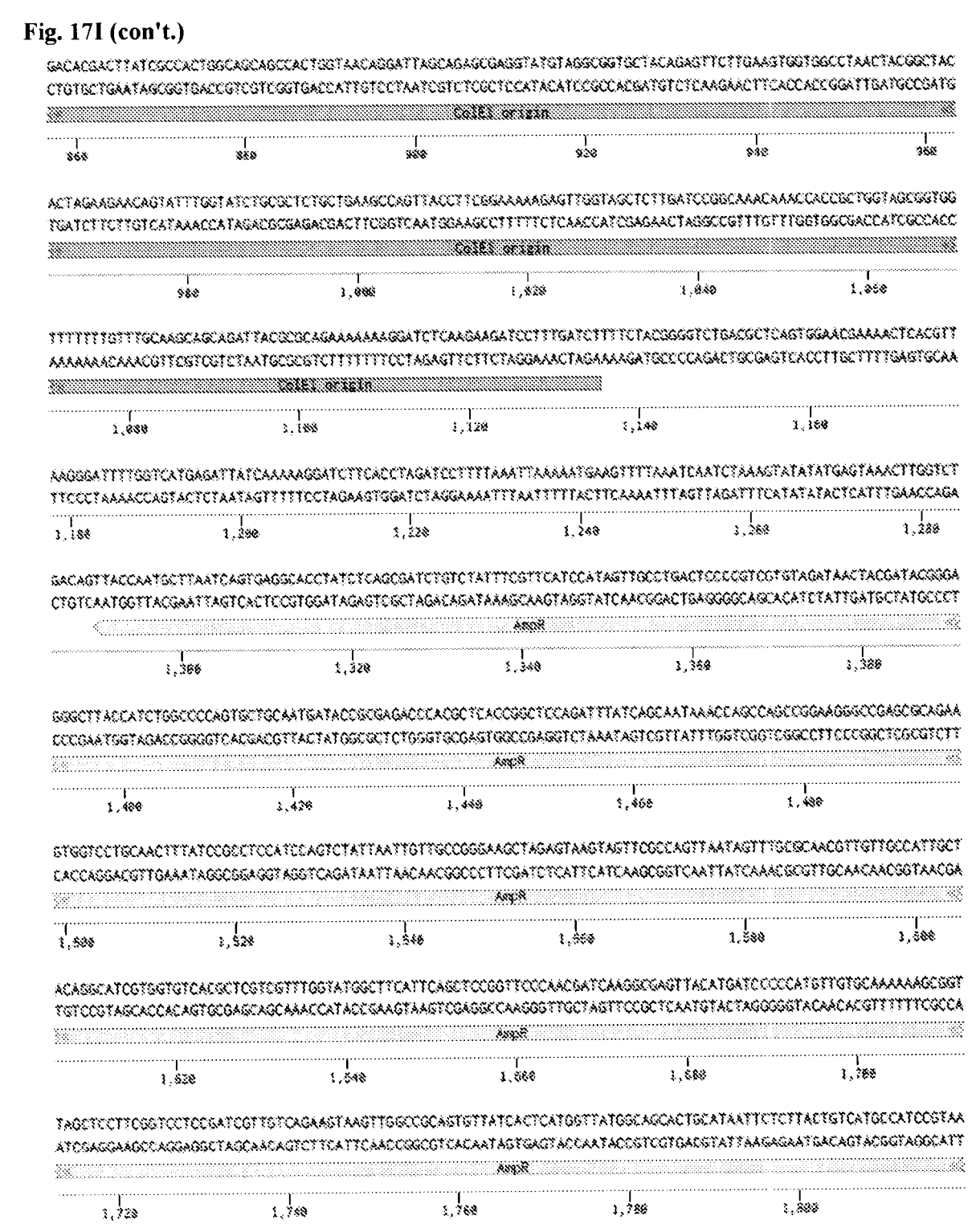
Figure 17J:
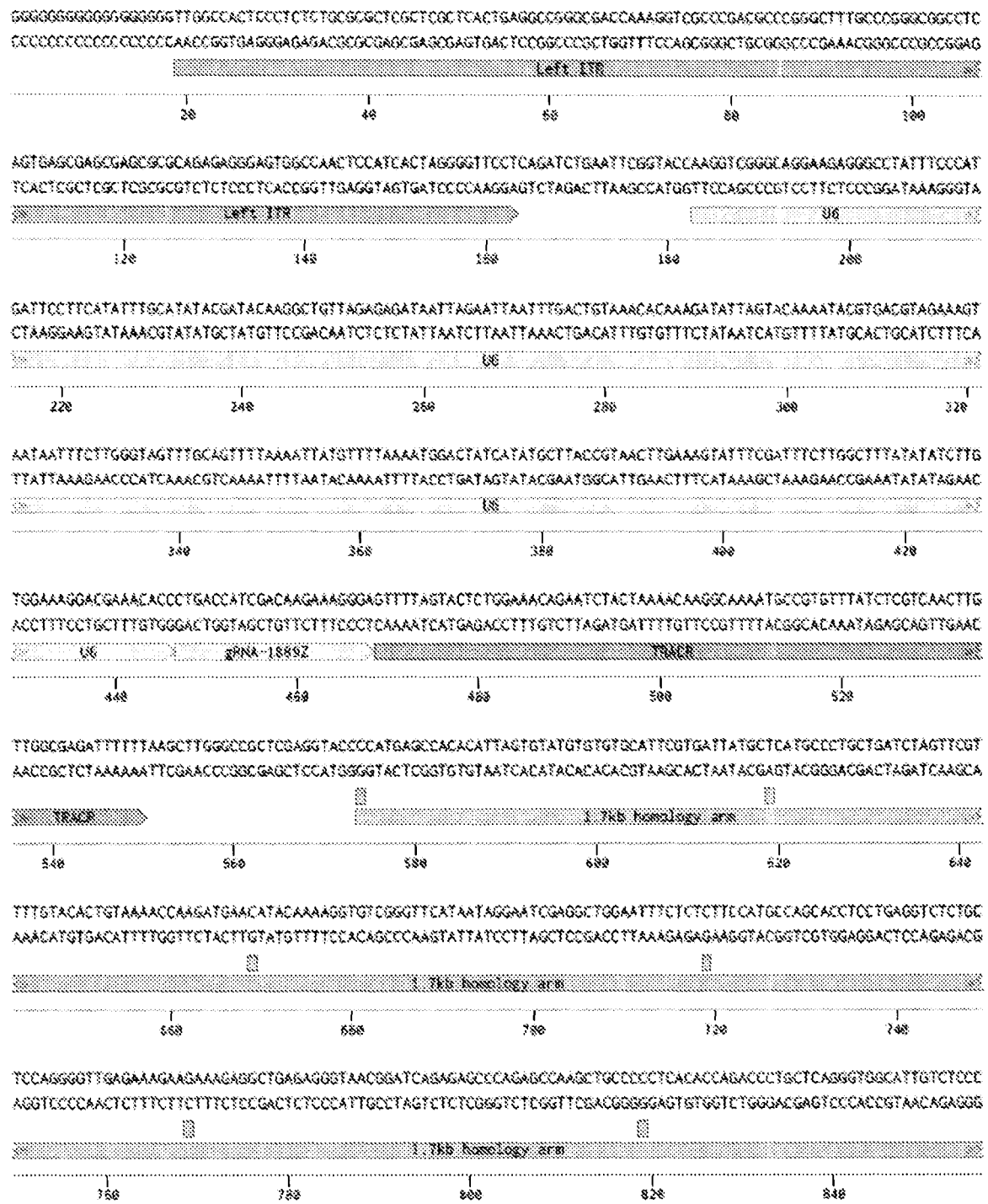
Figure 17K:
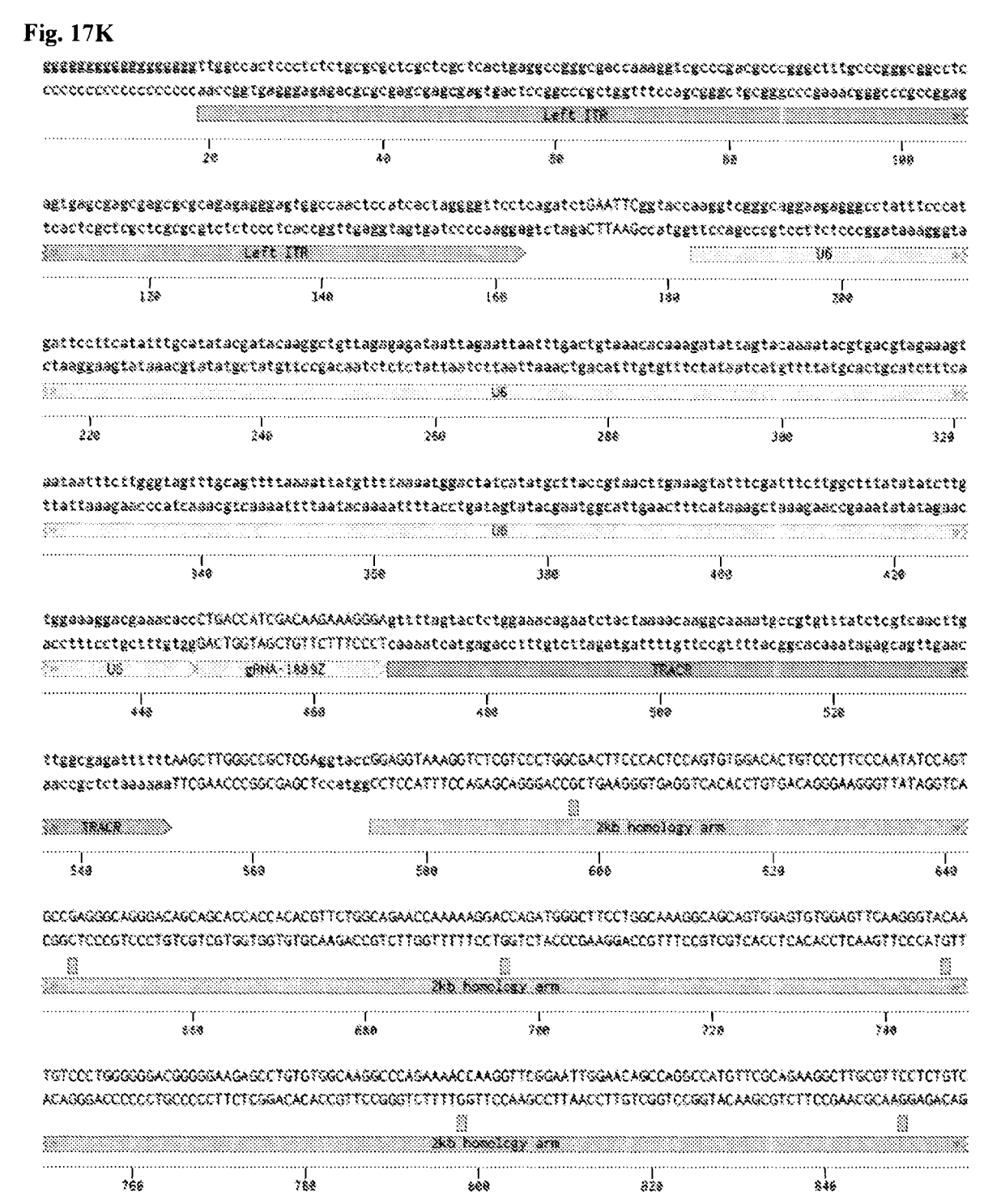
Figure 17K:
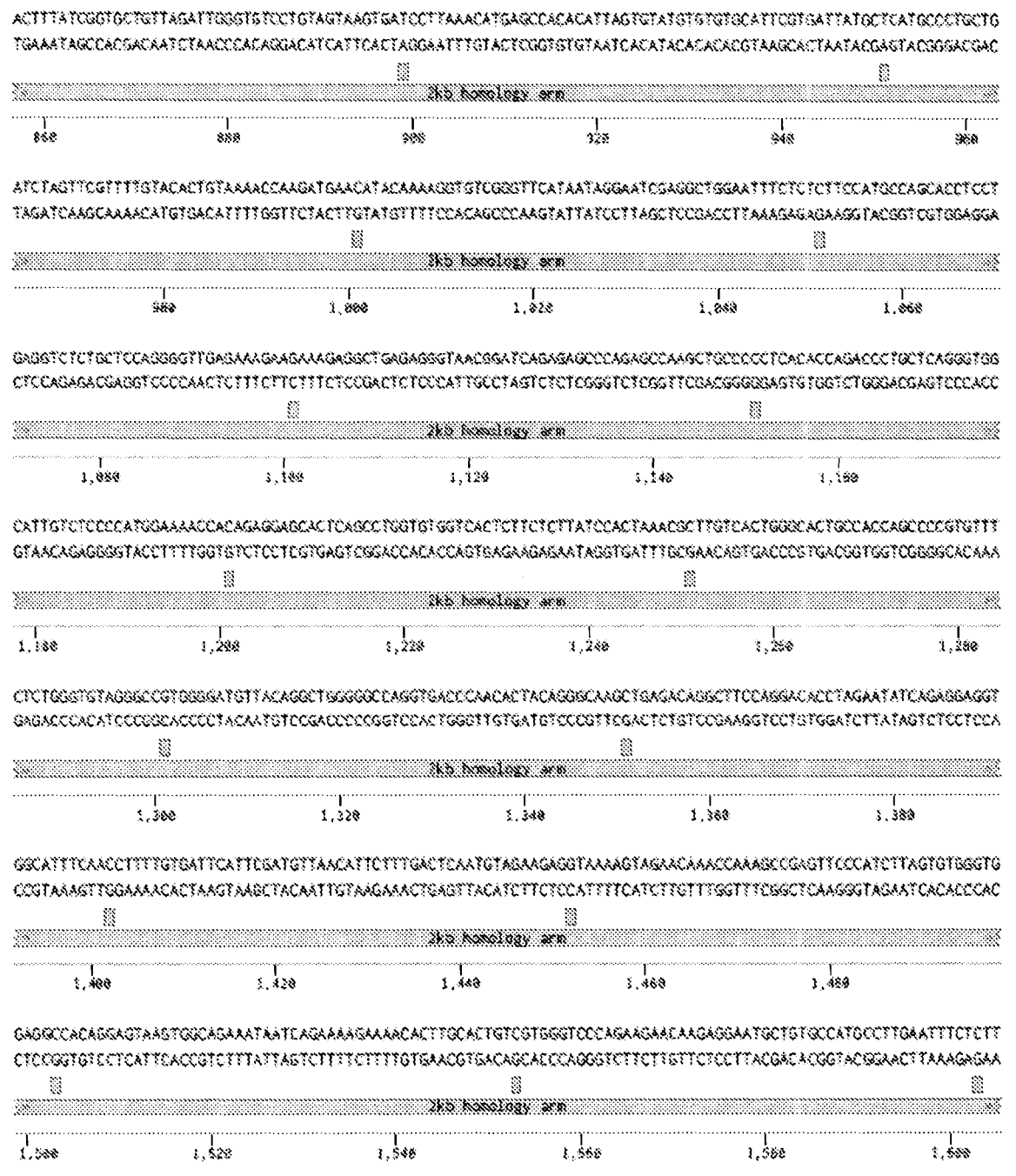
Figure 17K:
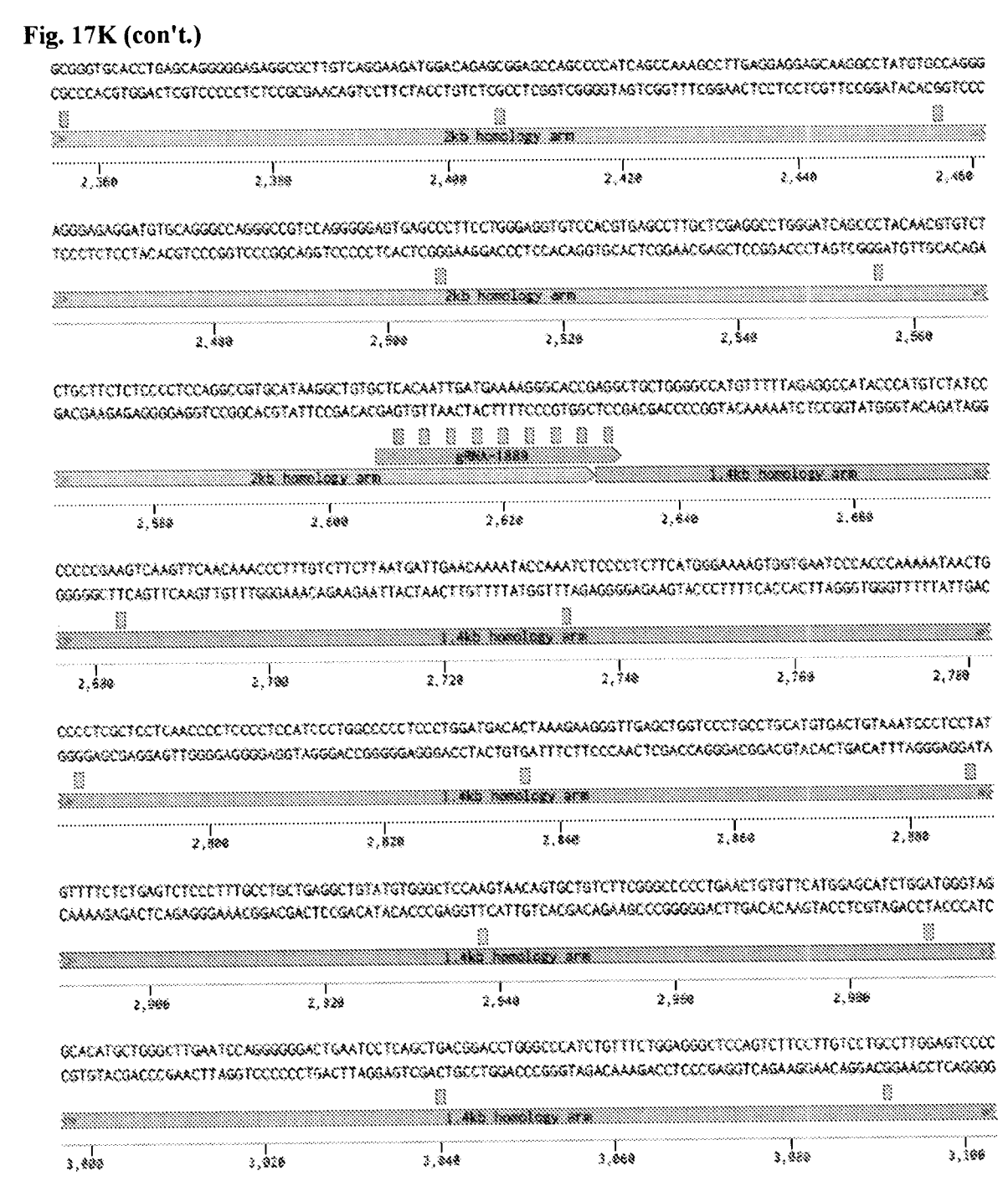
Figure 17K:
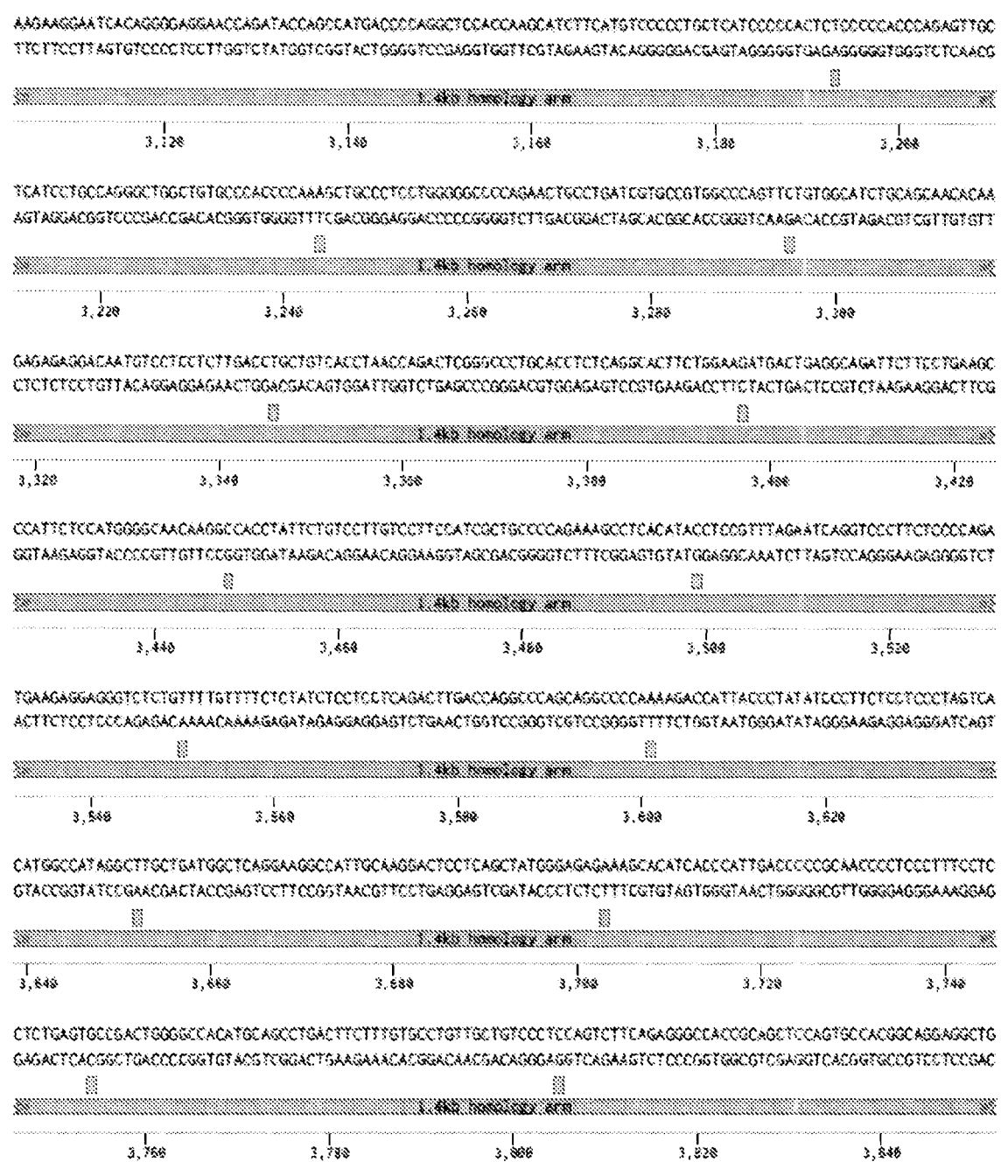
Figure 17K:
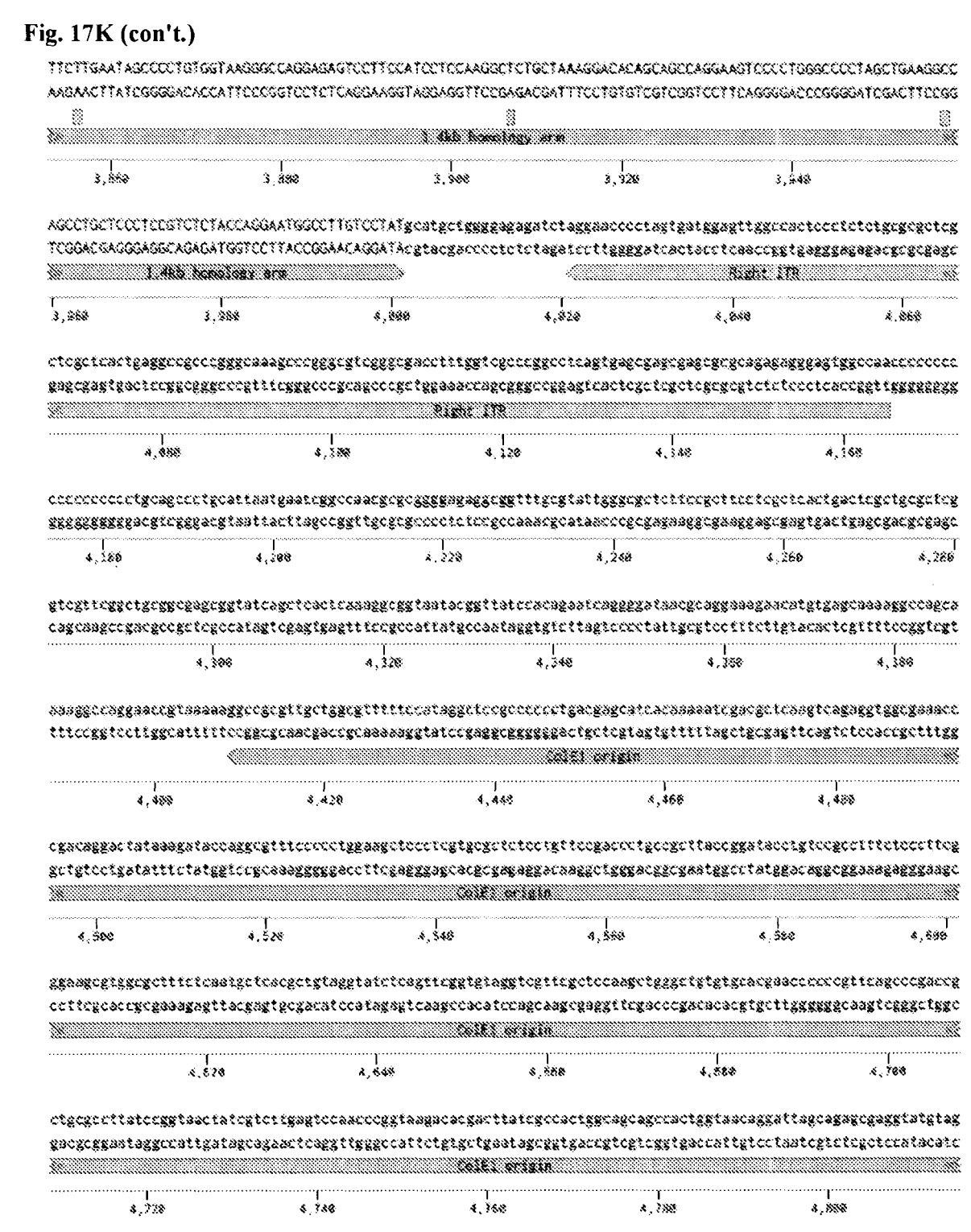
Figure 17K:
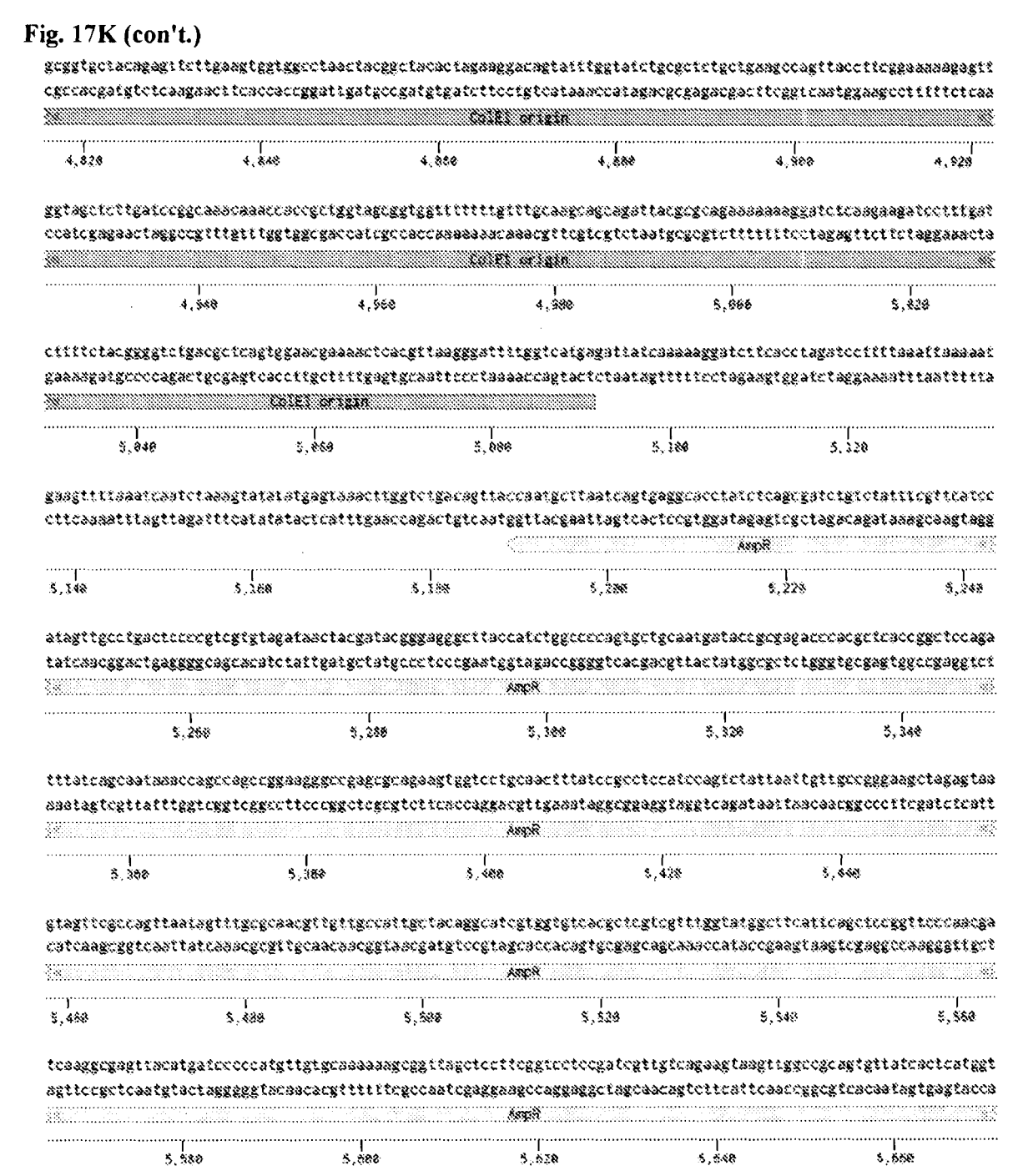
Figure 17K:
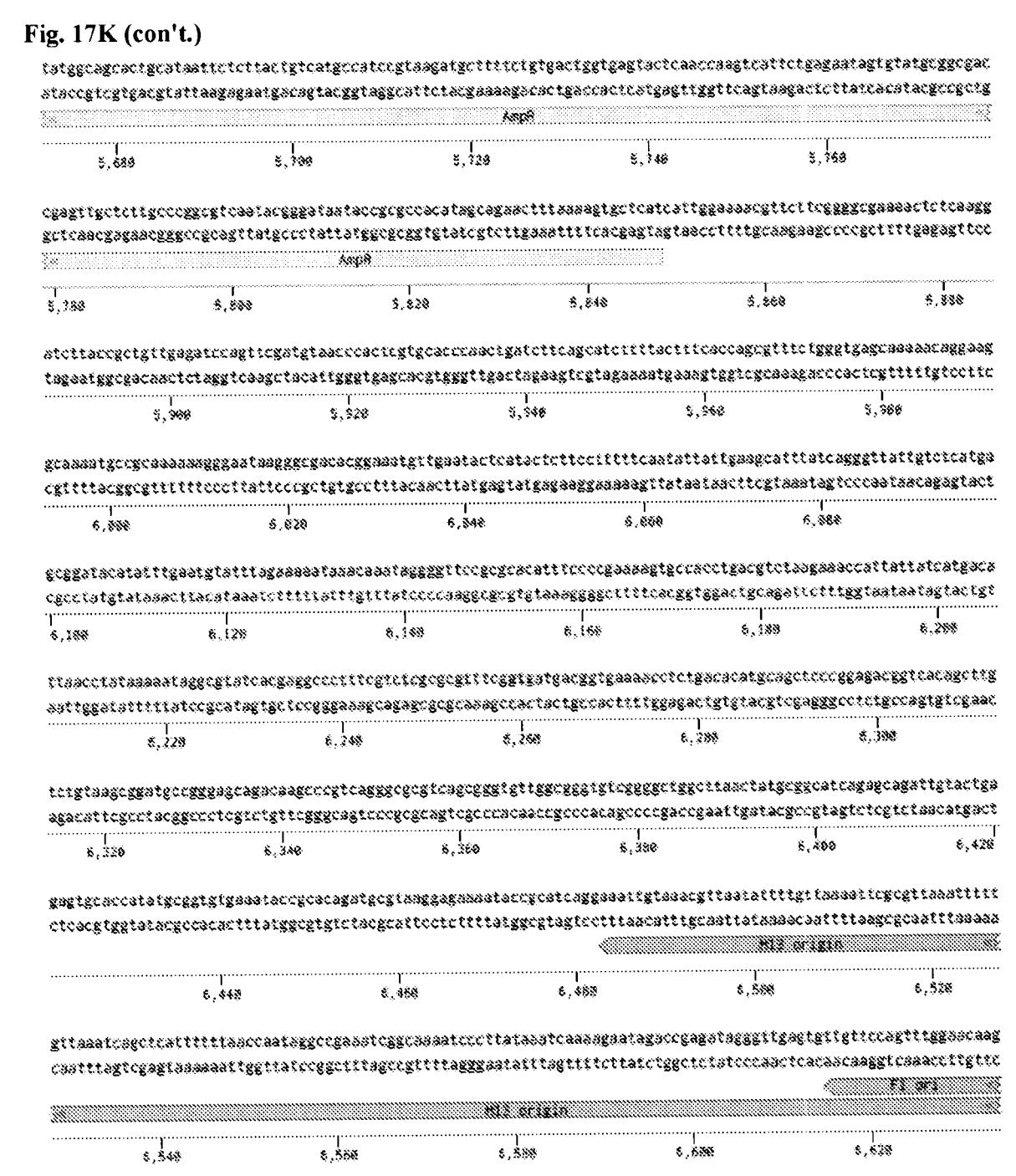
Figure 17K:
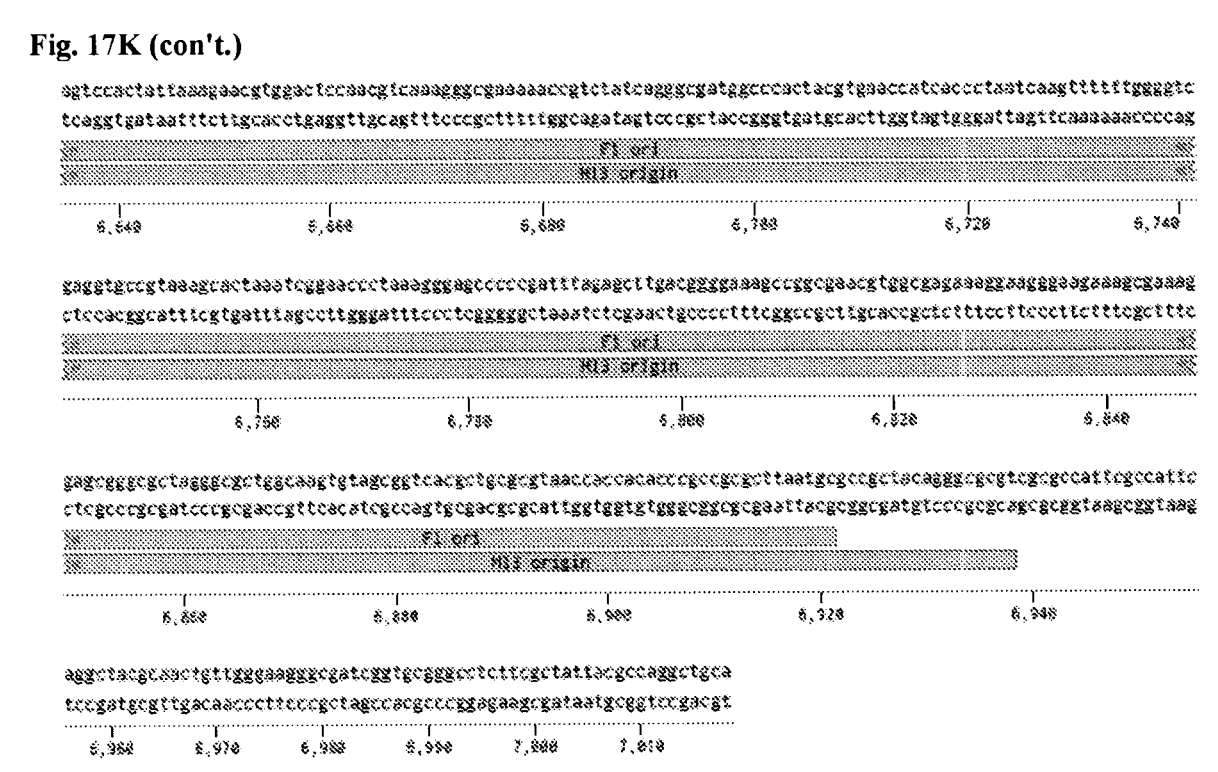
Figure 17L:
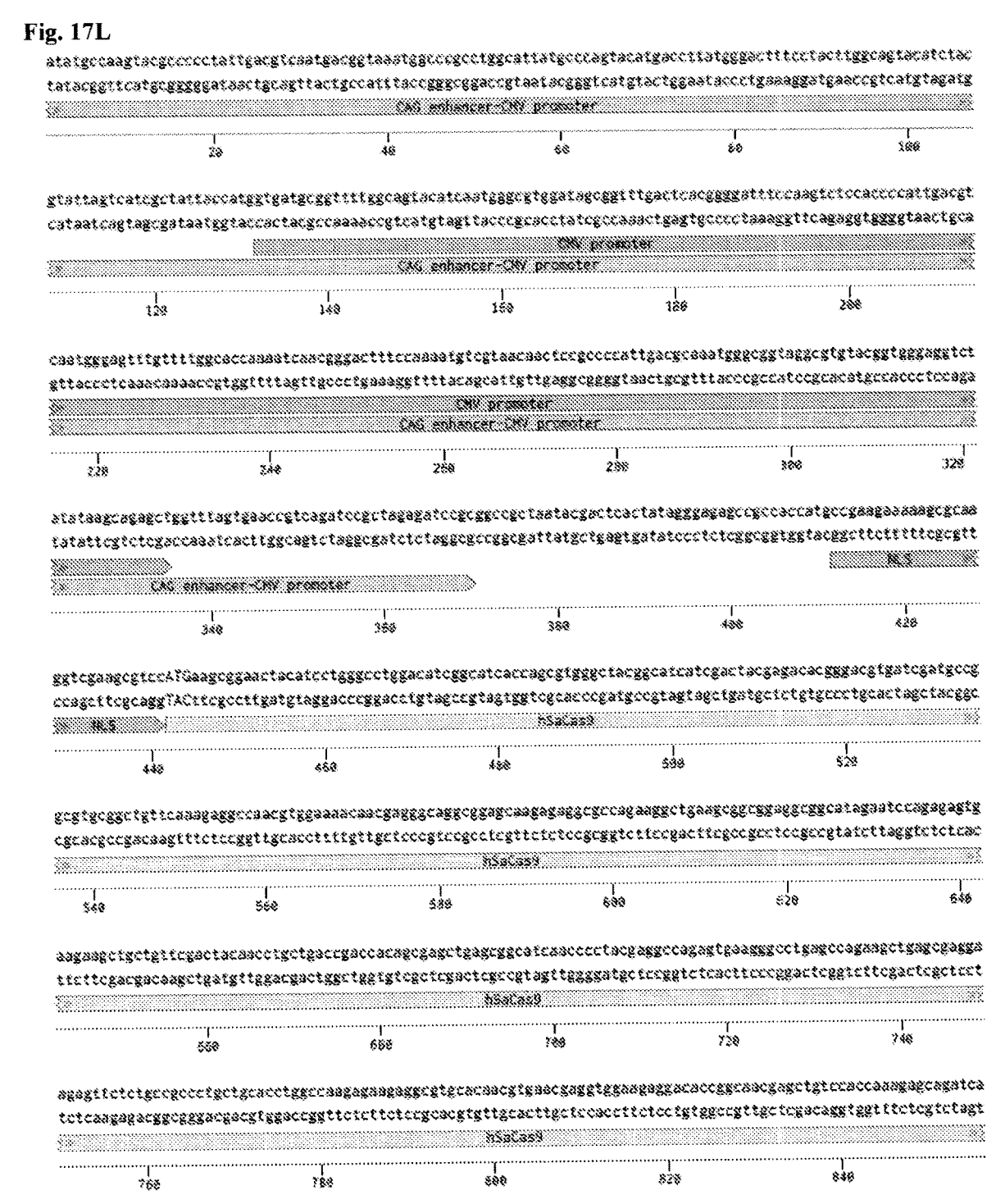
Figure 17L:
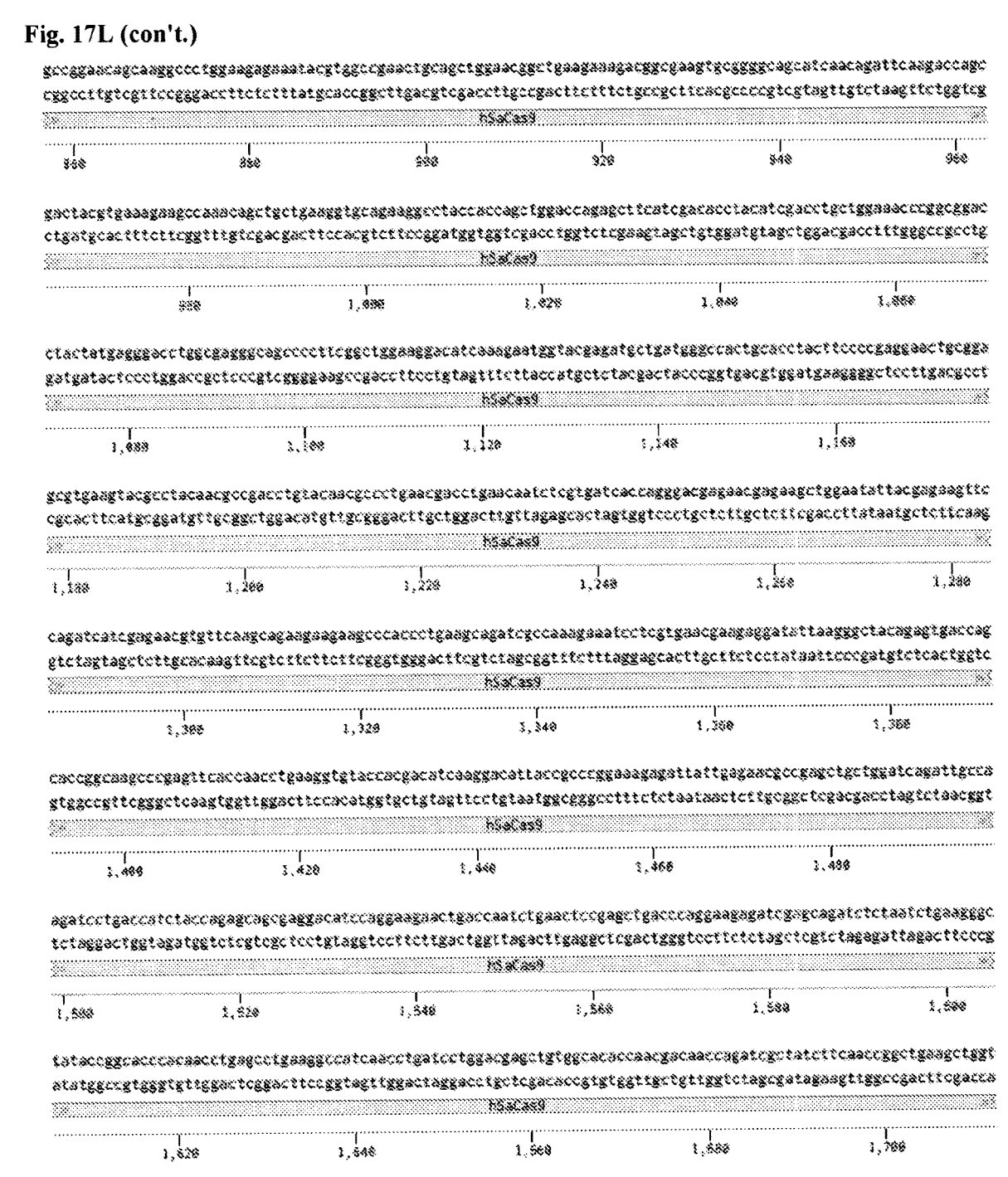
Figure 17L:
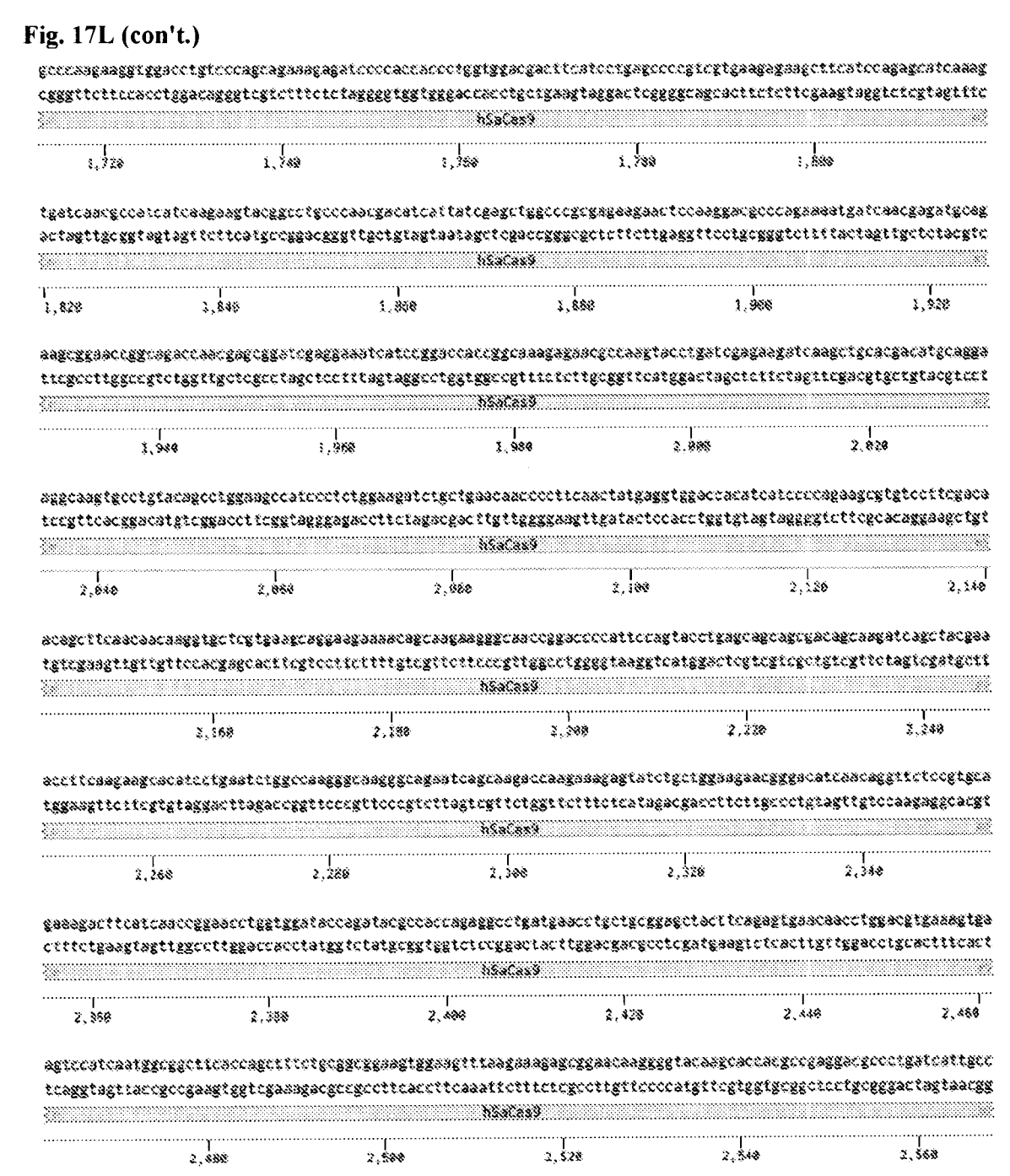
Figure 17L:
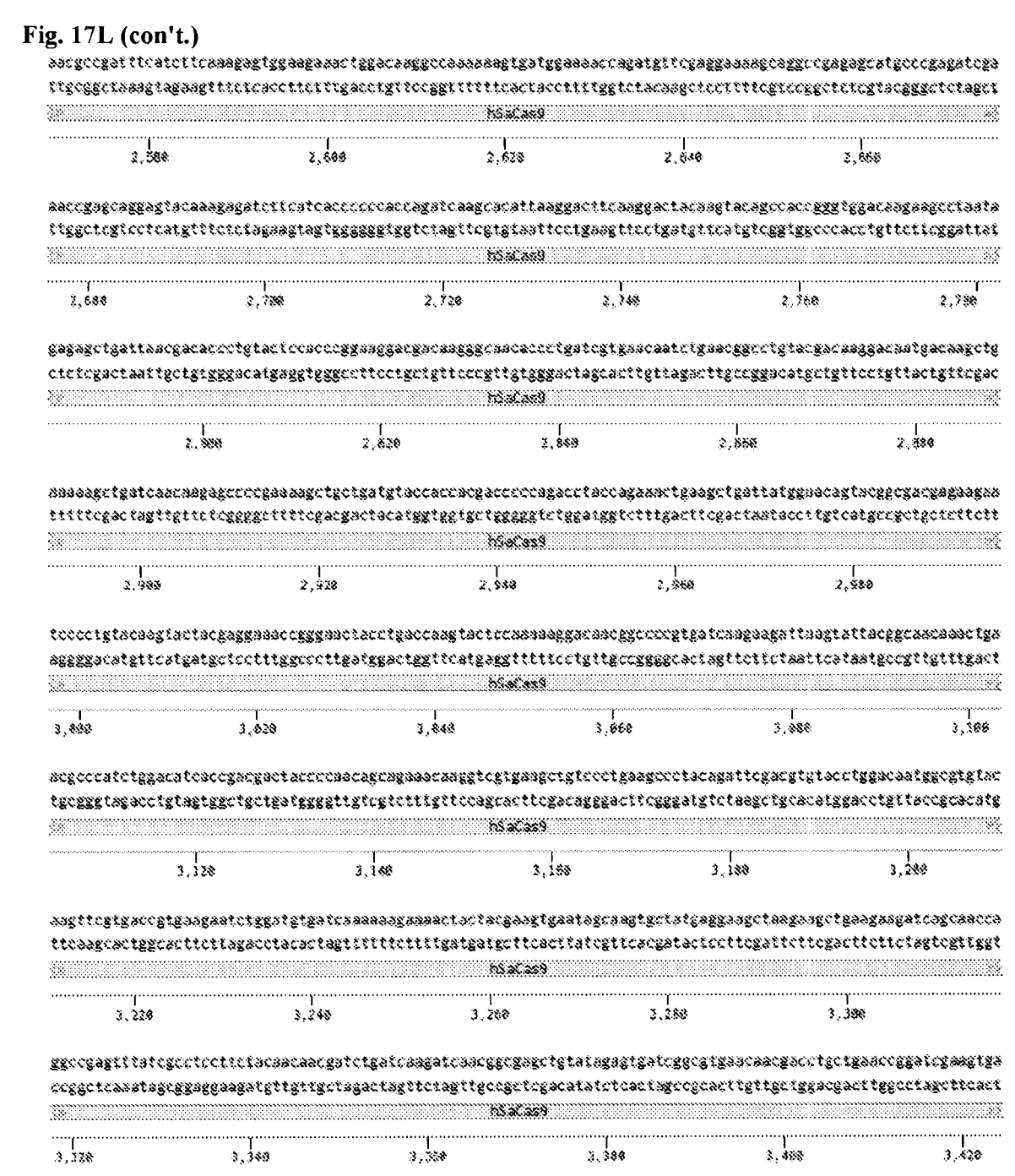
Figure 17L:
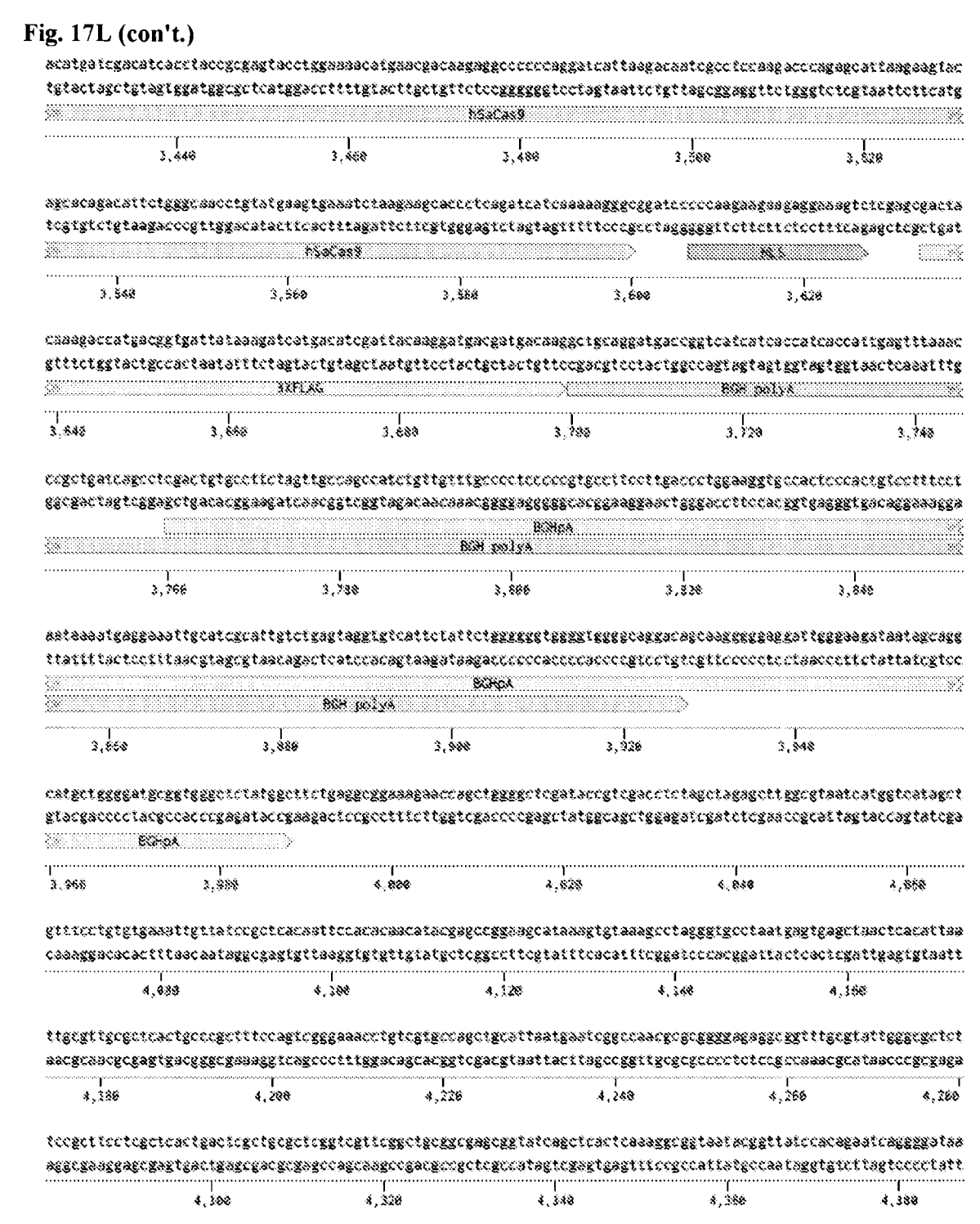
Figure 17L:
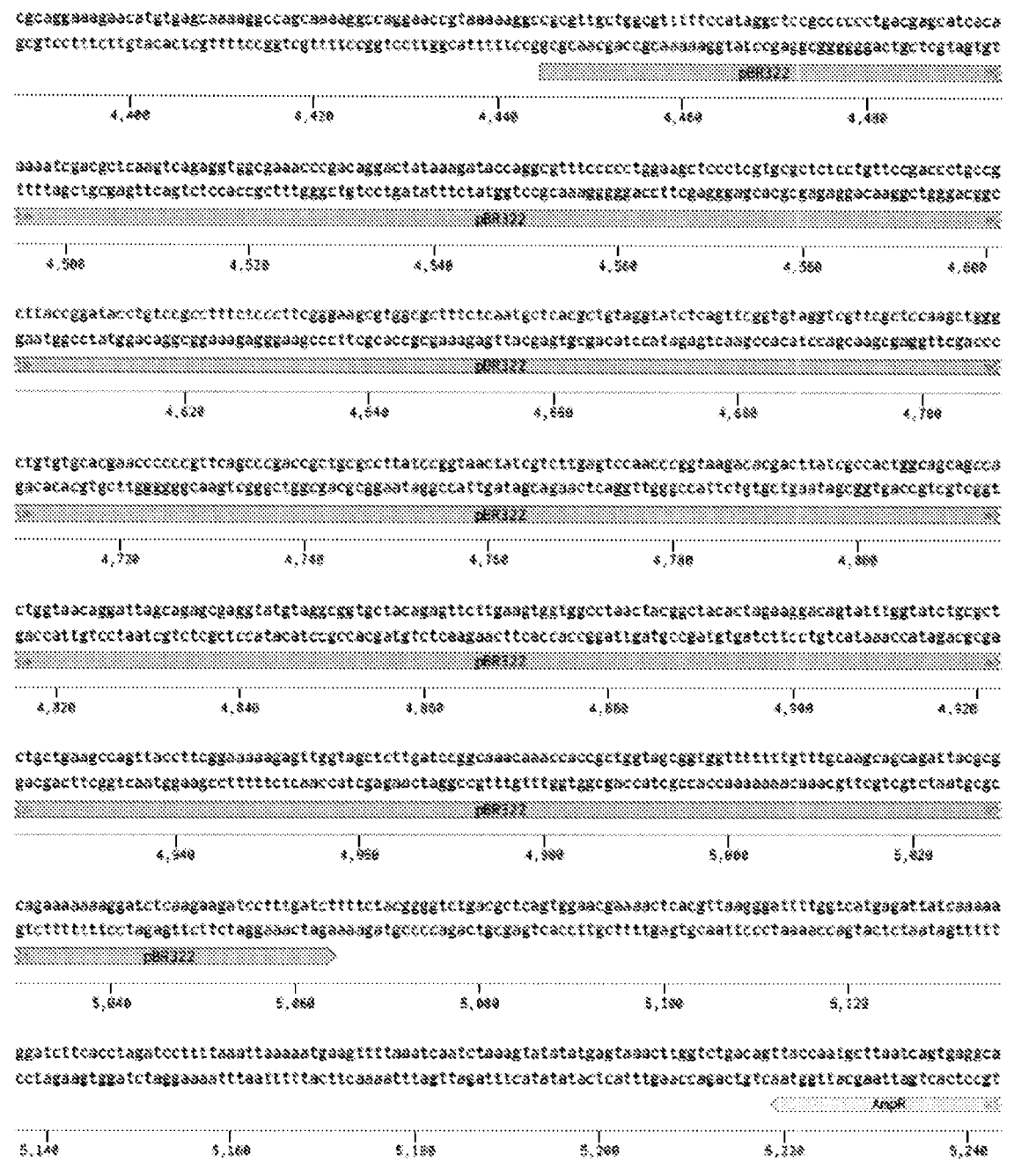
Figure 17L:
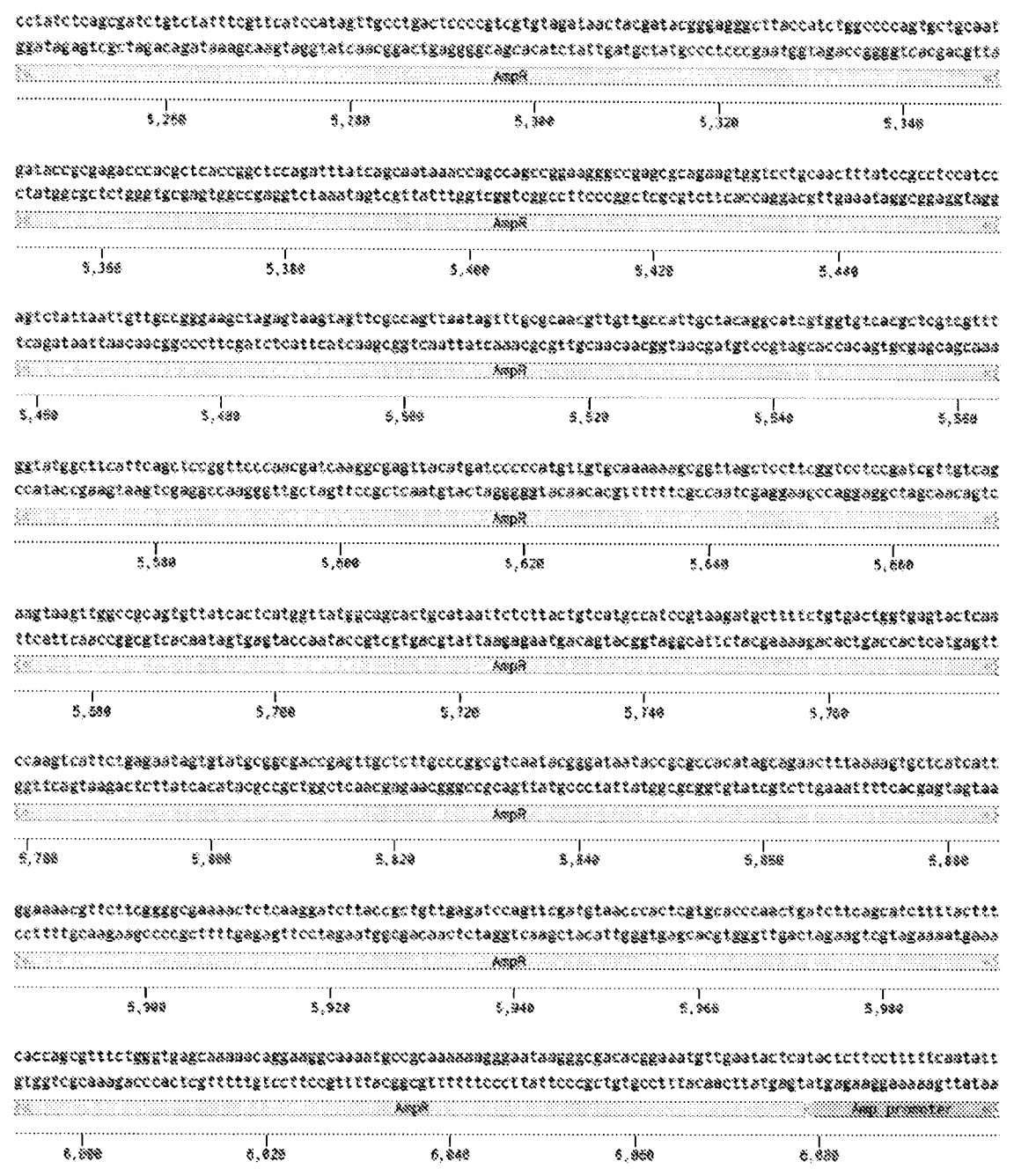
Figure 17L:
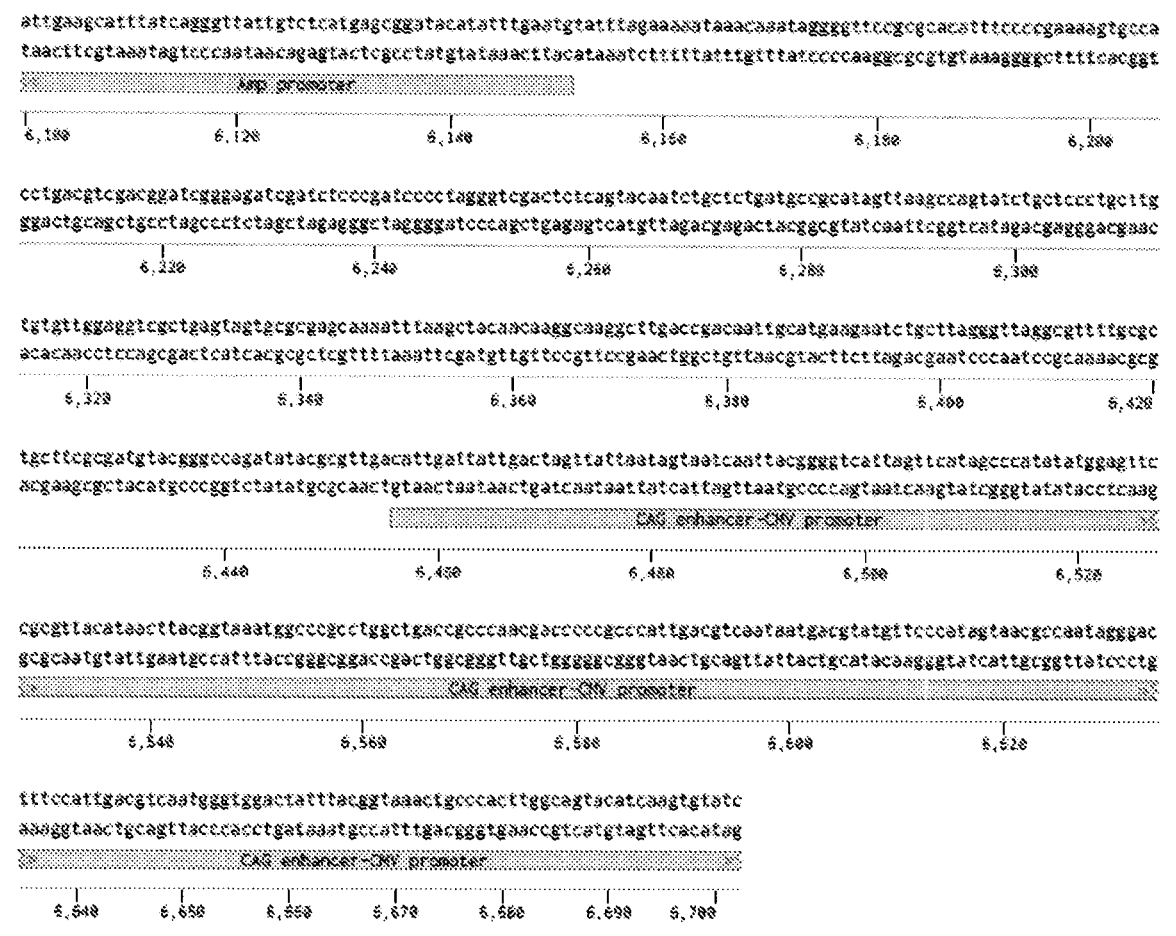
Figure 17M:
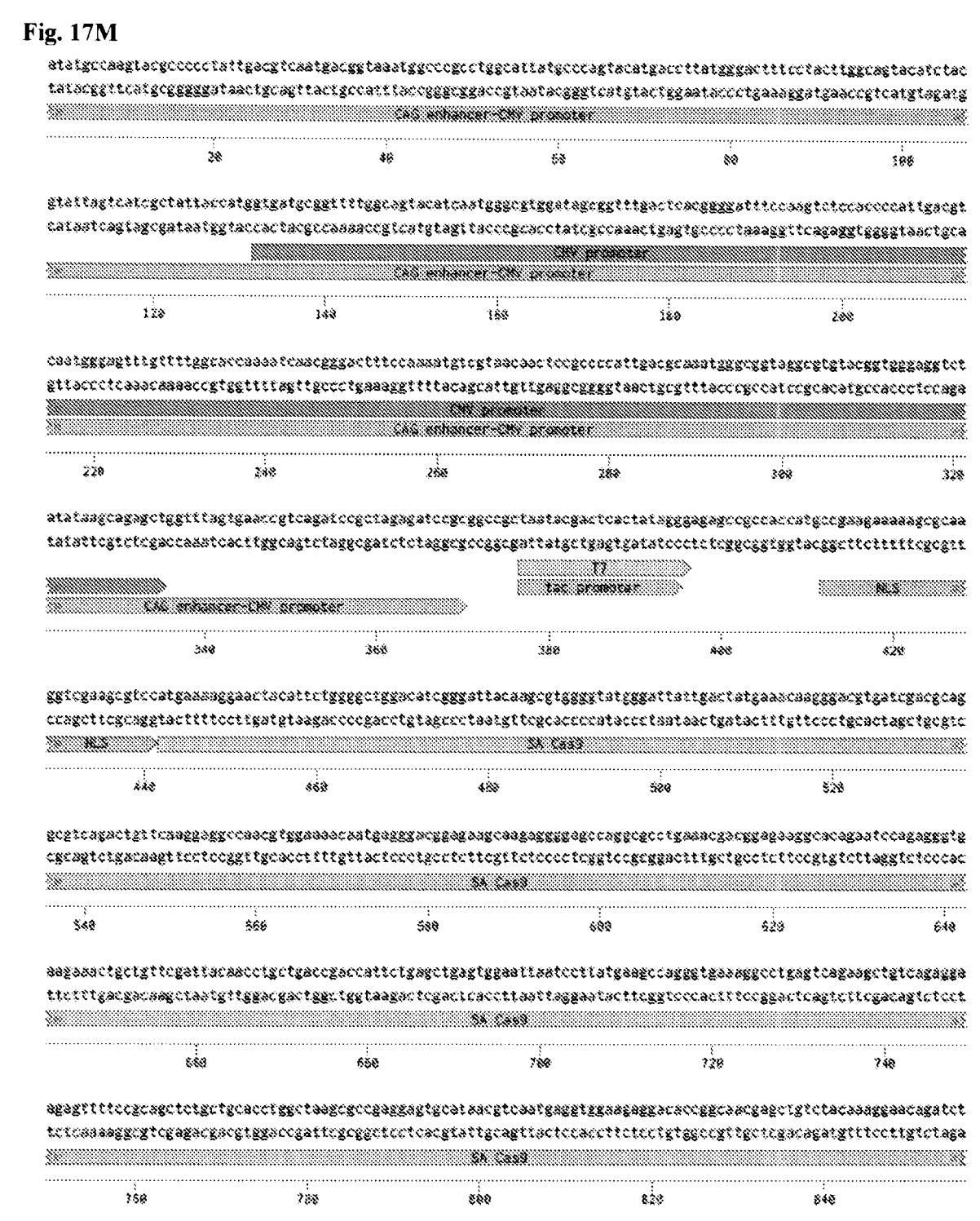
Figure 17M:
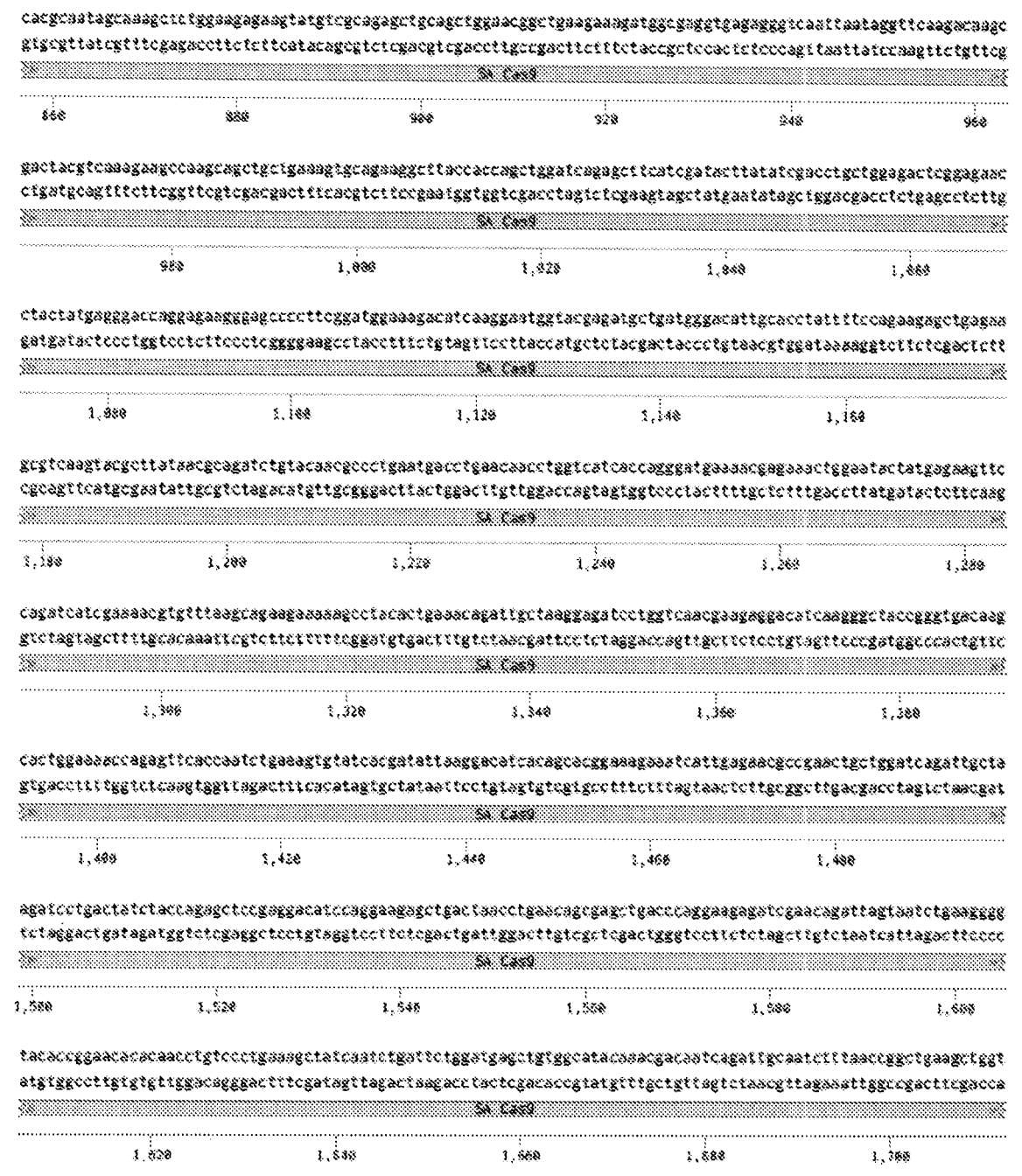
Figure 17M:
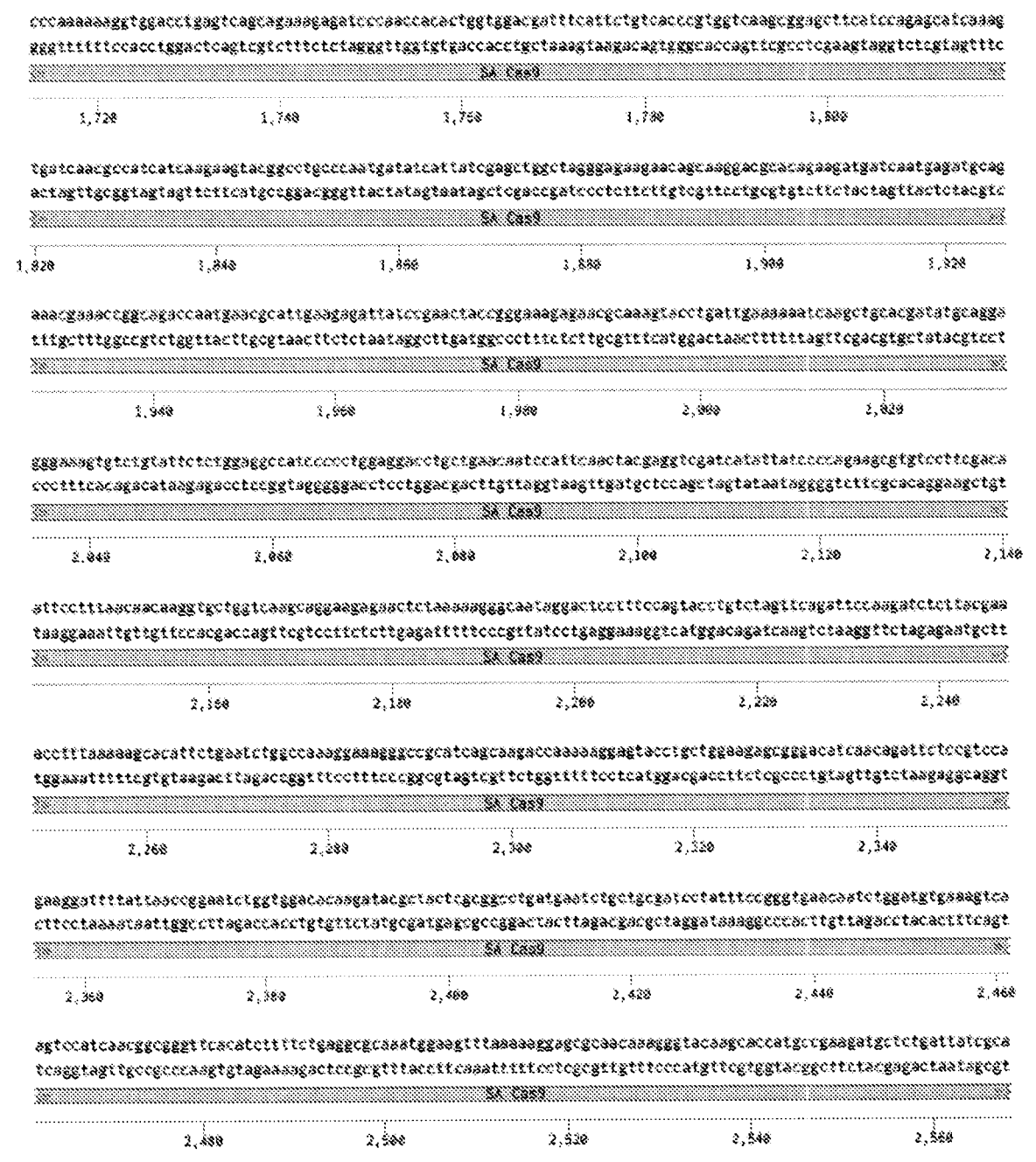
Figure 17M:
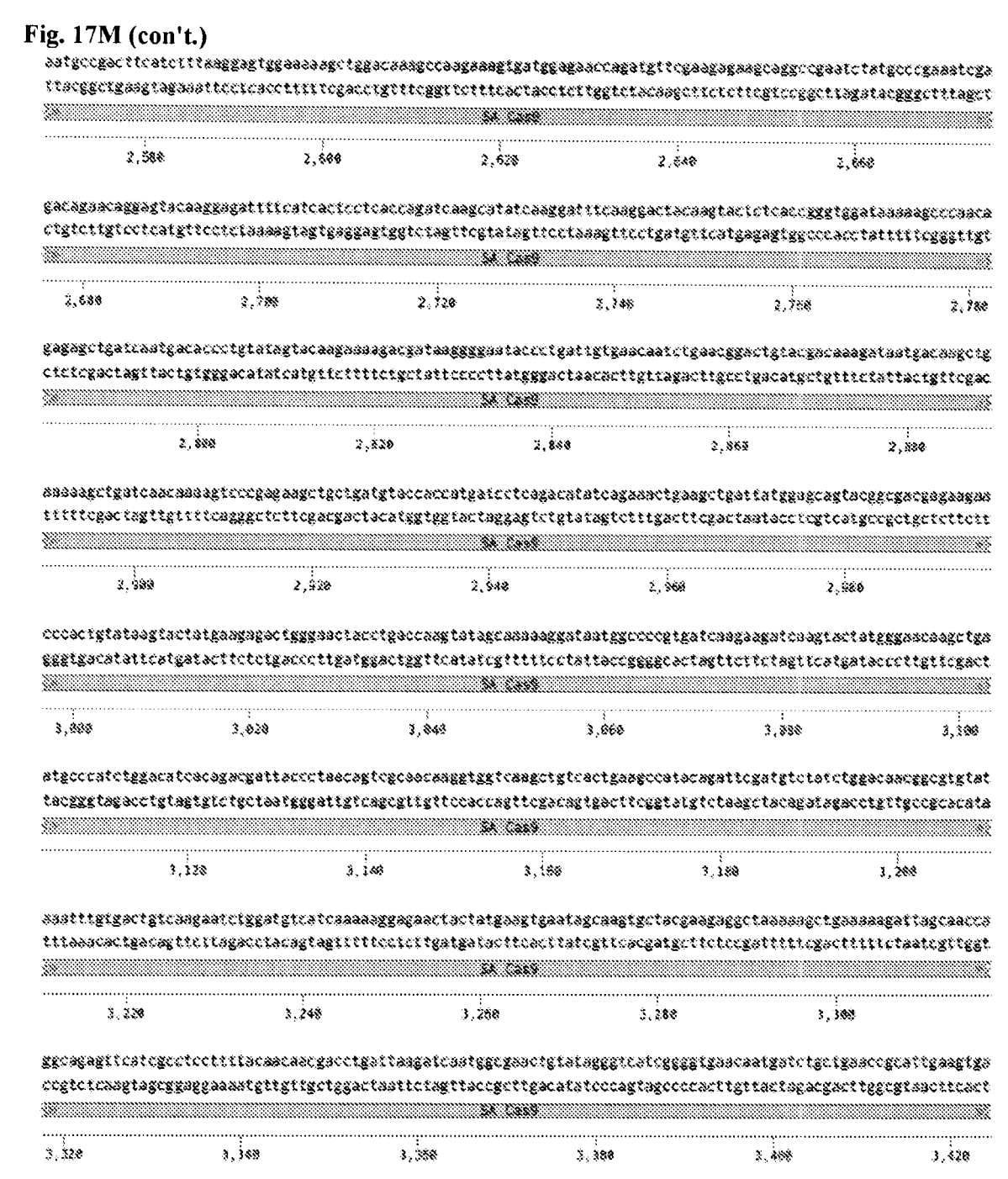
Figure 17M:
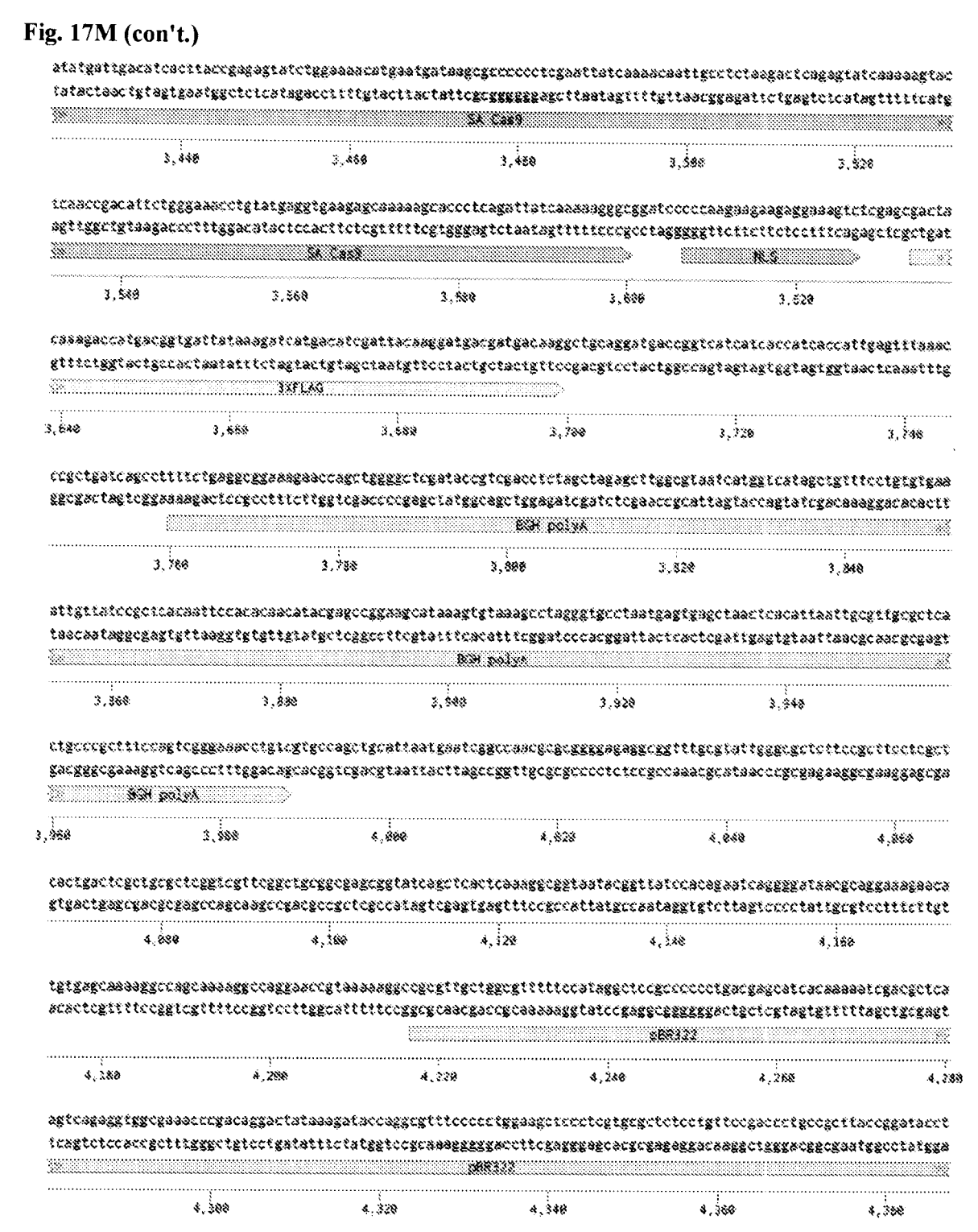
Figure 17M:
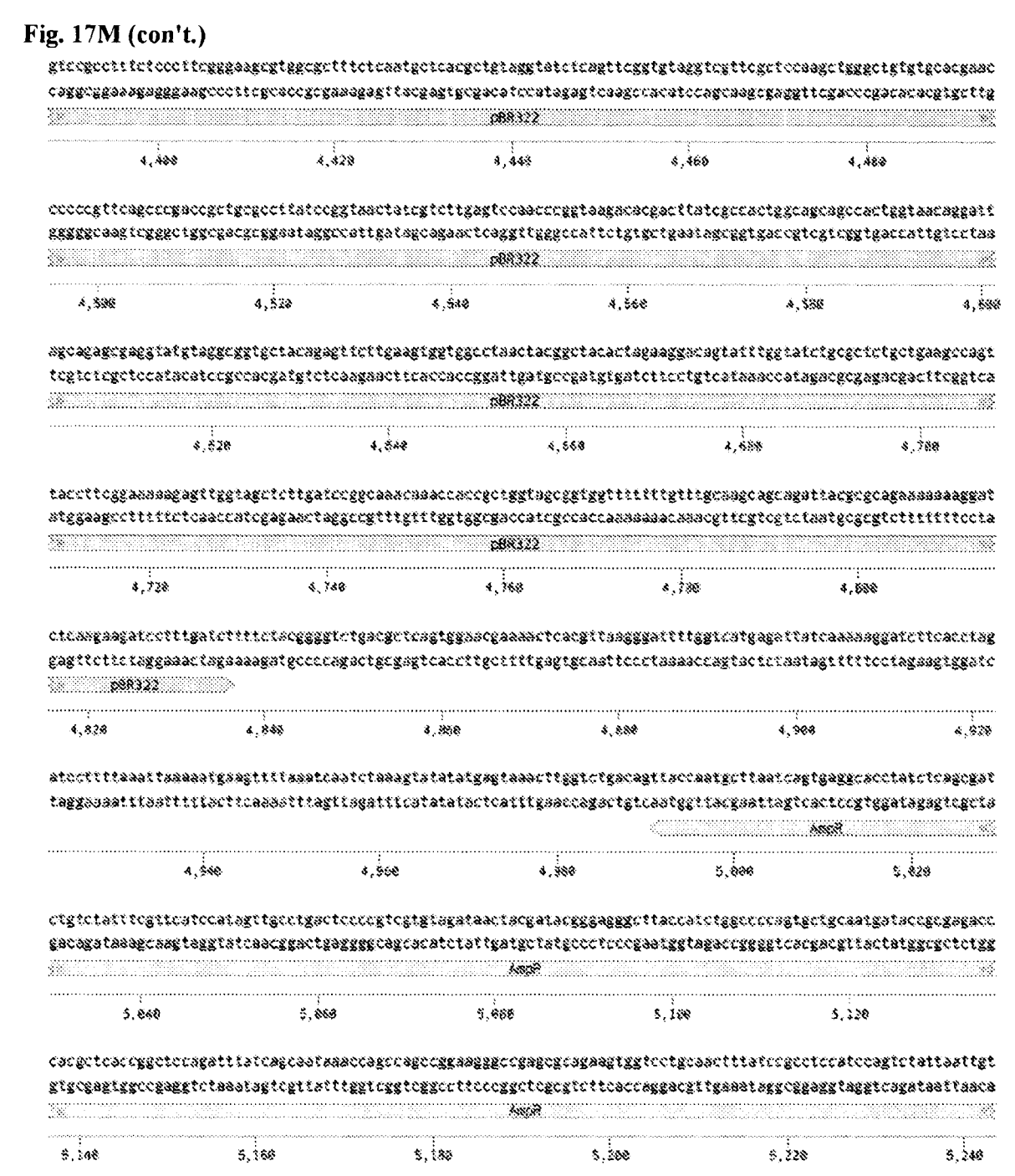
Figure 17M:
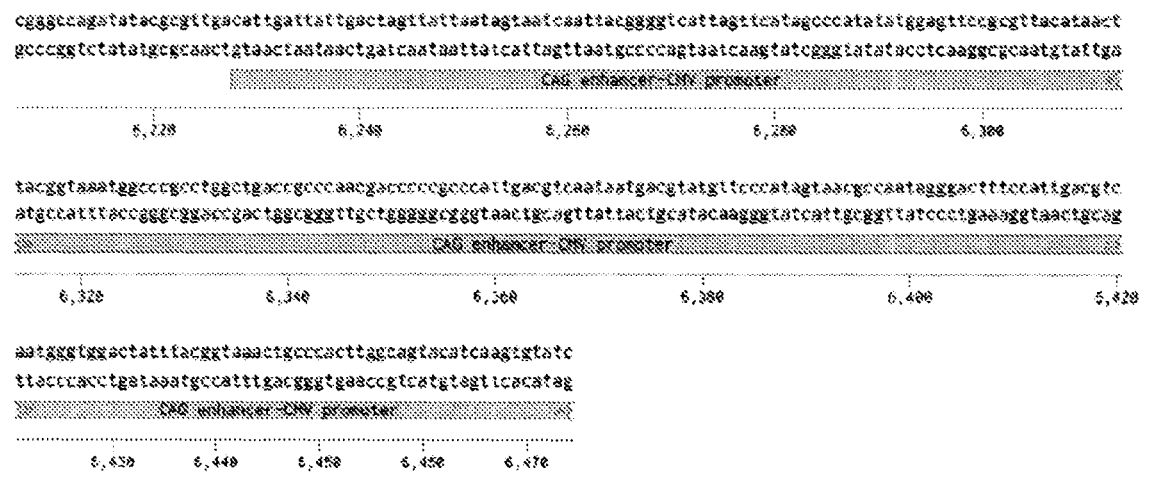

A dual-vector AAV system was constructed for CRISPR/Cas editing of DNA sequences (FIG. 15). To evaluate this dual-AAV vector system, four AAV proviral vectors were constructed and cloned: pSS99-1 (FIG. 16A, FIG. 17A), pMES02, pMES06 (FIG. 16J, FIG. 17J), and pMES08 (FIG. 16K, FIG. 17K). As depicted in FIG. 15, Vector A (pSS99-1) encodes a TBG-promoter-driven codon-optimized saCas9 with an N-terminal NLS, a C-terminal NLS, and a C-terminal triple Flag tag, followed by a full-length bGH polyA signal. Vector B (pMES06) contains a U6-driven sgRNA1889Z (comprising the targeting domain of SEQ ID NO:706) at the 5' end of the 1.7kb 5' homology arm, mutated targeting sequence of sgRNA1889Z (i.e., targeting domain of sgRNA1889Z comprising 10 or more mutations to avoid recognition by sgRNA1889Z), and the 1.7kb 3' homology arm. Vector C (pMES08) is an alternate version of Vector B that encodes the U6-driven sgRNA1889, a 2.0kb 5' homology arm, mutated target sequence of sgRNA1889Z (i.e., targeting domain of sgRNA1889Z comprising 10 or more mutations to avoid recognition by sgRNA1889Z), and a 1.4kb 3' homology arm. As a control, Vector D (pMES02) contains the same donor templates with mutated target and PAM-recognition sequences as in Vector A (pSS99-1) without the U6-gRNA module.

Example 8: Assessment of Gene Editing in Primary Human Hepatocytes

Primary human hepatocytes are purchased and maintained per instructions from vendors. Briefly, the cryoplateable human hepatocytes kept in the vapor phase of the liquid nitrogen tank are transferred and thawed in the 37° C. water bath. Once the hepatocytes are thawed, they are re-suspended in plating media and carefully transferred to a conical tube. The cells are then centrifuged at 100×g for 8 minutes at 4° C. and re-suspended again in plating media. Cell density and viability in the suspension is counted and calculated using a hemocytometer. Between $0.7$-$0.9 \times 10^6$ hepatocytes are plated per well in collagen-treated 24-well plates followed by agitation of the plates at 15 minute intervals for the first one hour. Cultures are maintained in a 37C incubator with 5% $CO_2$. Fresh maintenance media is replaced every 24 hours for the plated hepatocytes to ensure optimum growth conditions.

To evaluate the activity of saCas9 and gRNA targeting a hSERPINA1 locus, primary hepatocytes are transfected with (1) plasmids encoding saCas9, plasmids encoding sgRNA, and ssODN donor template; (2) mRNA transcript of saCas9, synthetic or in vitro transcribed sgRNA, and ssODN donor template; or (3) ribonucleoprotein complex (RNP) of recombinant Cas9 and gRNA together with ssODN donor template. Five days post transfection, primary hepatocytes are harvested to extract gDNA. T7E1 assay, RFLP assay, and NextGen sequencing are carried out as described above to assess the gene modification frequencies.

To assess the design and activity of the aforementioned dual-AAV system in modifying Exon V of hSERPINA1, AAV6 vectors were prepared with proviral vectors pSS99-1, pMES02, pMES06, and pMES08. Primary human hepatocytes plated on collagen-treated 24-well plates are transduced with these AAV6 vectors expressing saCas9 and encoding HDR donor template at various Multiplicities of Infection (MOI). Five days post transduction, cells are collected and gDNA from these hepatocytes are extracted to carry out T7E1 assay, RFLP assay, and NextGen sequencing to evaluate the gene modification events.

Example 9: Assessment of AAV-Mediated HDR in PiZ Transgenic Mice (Approach 1A)

A Dual-AA V Vector System Introduces Targeted Gene Correction of the Z Mutation on Exon V of SERPINA1 In Vivo Natural history studies revealed that liver patients are at high risk of developing lung emphysema in their late 50s or 60s. Currently, there is no reliable treatment for the lung disease associated with AATD and only a small fraction of the lung disease patients are recommended protein replacement therapy to increase their circulating AAT concentration (Sandhaus 2016). As a result, it was hypothesized that targeted gene correction of the Z mutations on SERPINA1 could be beneficial for both liver and lung symptoms simultaneously, providing a one-time treatment.

To test this hypothesis, a gene editing approach was designed to treat AATD-associated diseases, mediated by a Homology-directed DNA Repair (HDR) for both the liver and lung diseases. Specifically, a dual-vector approach was designed to take advantage of the high frequency HDR induced by AAV vectors in correcting the Z mutations on hSERPINA1 to the wild-type M alleles in PiZ mice. AAV has been previously reported to increase HDR rates in ex vivo systems, including primary T-cells (Wang 2016) and hematopoietic stem cells (HSCs) (Dever 2016; Sather 2015). The single guide RNA, sgRNA-1889Z, which comprises the targeting domain of SEQ ID NO:706, was chosen for the in vivo study as described herein in Example 9. In certain embodiments, other sgRNAs may be used in the dual vector approach provided herein.

Recombinant AAV vectors packaging proviral vectors pSS99-1, pMES06, and pMES08 were produced and purified as described above in Example 7. As shown in FIG. 20A, these proviral vectors include two types of AAV transgenes. The first AAV vector encodes TBG-driven saCas9 with NLS signals and a triple Flag-tag followed by a full-length bovine growth hormone polyA (bGHpA) tail (see pSS99-1 (i.e., Cas9) (FIG. 16A, FIG. 17A)). The second type of AAV vector delivers U6-driven sgRNA-1889Z (comprising the targeting domain of SEQ ID NO:706) and different HDR donor templates (see pMES06 (FIG. 16J, FIG. 17J) and pMES08 (FIG. 16K, FIG. 17K)). In certain embodiments, other AAV transgenes may be used in the dual vector approach provided herein, including but not limited to, pMES02.

Two HDR template configurations were tested, both with 10 mutations introduced on the targeting sequence and PAM to avoid re-cutting after DNA repair. AAV8-MES06 delivers homology arms of 1.7 kb in length on either end of the mutated target site; AAV8-MES08 shifted the balance of the homology arms to 60% of sequence on the 5' end and 40% on the 3' end relevant to the mutated target site (2.1kb+1.4 kb). It has been shown that an unbalanced design of single-stranded oligonucleotide (ssODN) as donor template could enhance HDR frequencies in cell culture. Thus, it was investigated if the same phenomenon holds true when more extended homology arms are involved.

The PiZ mice as described in Example 2 were used for the experiments provided, herein in Example 9. Briefly, PiZ mice were bred and maintained in an AAALAC-accredited facility at SLU School of Medicine as in Carlson 1989. All procedures were in accordance with the animal protocol approved by the Institutional Animal Care and Use Committee (IACUC) at SLU. Mice homozygous for the human PiZ alleles were bred with C57B6 males (Jackson Laboratories) to obtain heterozygous offspring. All studies were conducted with heterozygous mice. Dosing groups were designed to include at least one PBS control animal in each litter of animals.

Mixed-gender, heterozygous PiZ mice at age of 5-11 weeks were dosed in four groups: (1) PBS control (6 mice/group), (2) 1.28e14 vg/kg of AAV8-MES06 alone as vehicle control (6 mice/group), (3) 5e13 vg/kg of AAV8-Cas9 on Day 0 and 1.28e14 vg/kg of AAV8-MES06 on Day 1 (9 mice/group), (3) 5e13 vg/kg of AAV8-Cas9 on Day 0 and 1.28e14 vg/kg of AAV8-MES08 on Day 1 (9 mice/ group). The dose of AAV8-Cas9 vectors was kept consistent with previous AAV8-Cas9 studies to ensure sufficient Cas9 expressions in the liver. The dose of AAV8-MES06 or AAV8-MES08 was 2.56× of AAV8-Cas9 due to the limiting concentration of viral preparations. On Day 0, PiZ mice were injected with PBS or AAV8-Cas9 vectors. 24 hours later, PiZ mice were injected with PBS, AAV8-MES06, or AAV8-MES08, accordingly. Animals were bled on Days −2, 0 (3 hours prior to dosing), 7, 14, 21, 28, 35, 42, 49, and 56 to collect serum for AAT ELISA. Cohorts of mice from each treatment group were sacrificed on Days 28, 42, and 56 to investigate the kinetics of therapeutic effects in hepatocytes by histology (FIG. 20B). The cohorts of mice sacrificed were as follows: Day 28 (PBS group, 2 mice; AAV8-MES06 group, 2 mice; AAV8-Cas9+AAV8-MES06, 3 mice; AAV8-Cas9+AAV8-MES08, 3 mice); Day 42 (PBS group, 2 mice; AAV8-MES06 group, 2 mice; AAV8-Cas9+AAV8-MES06, 3 mice; AAV8-Cas9+AAV8-MES08, 3 mice); and Day 56 (PBS group, 2 mice; AAV8-MES06 group, 2 mice; AAV8-Cas9+AAV8-MES06, 3 mice; AAV8-Cas9+AAV8-MES08, 3 mice).

The 3.5kb homology templates delivered by AAV8 impose challenges in amplifying gene loci of interest near the Cas9 cut site. At a dose of 1.28e14 vg/kg, it is estimated to be >500 viral genome/quadruploid hepatocyte immediately after intravenous injections. It is difficult to PCR amplify 500 bp fragments for Illumina sequencing from genomic DNA in the presence of >500 copies of highly homologous sequences. Therefore, in order to analyze genetic modifications near the Z mutation, whole-transcriptome RNAseq of the total RNA extracted from PiZ mouse livers were conducted at Day 56 post injections. Briefly, total RNA was extracted from pulverized liver samples using RNeasy Mini Kits (Qiagen). RNA concentration and integrity were assayed using RNA 600 Nano Kits (Agilent) on a Bioanalyzer (Agilent) to determine an RNA Integrity Number (RIN) greater than 6.5. RNA was treated Turbo DNA-free Kit (Ambion) and reverse-transcribed using Superscript III RT (Invitrogen). RNAseq library preparations and HiSeq runs were conducted at Genewiz. Ribosomal RNA depletion was performed prior to stranded RNA library preparation. Data were analyzed in-house and visualized with Integrative Genomics Viewer (The Broad Institute). With depletions of total DNA prior to reverse transcription, contamination from AAV genomes during analysis of the genomic DNA was avoided. RNAseq revealed that the total hSERPINA1 expression relative to mouse B2M was significantly reduced (by 85%) in mice treated with the dual-AAV vector system (FIG. 20C). SERPINA1 expression decreased by 35% in the AAV8-MES06 control group.

Next, the specific nucleotide changes on the targeting sequence and PAM in the remaining mRNA of hSERPINA1 were investigated using RNAseq. All ten intended mutations on the donor templates were detected from read alignments. Consistent with previous reports, the highest nucleotide substitution frequency occurred near the cut site at 6% of the total hSERPINA1 transcripts. The nucleotide responsible for the Z-to-M transition (A>C substitution) showed 4.3% correction with AAV8-Cas9+AAV8-MES06, and 4.8% correction with AAV8-Cas9+AAV8-MES08 (FIG. 20D). The rest of the eight mutations occur at frequencies of 3-4%, slightly decreasing the further they are away from the cut site. These results indicate that ~5% of the AAT transcripts from the PiZ mouse livers are the more active M form of AAT at 56 days post dual-vector injections.

Amelioration of the Liver Diseases in PiZ Mice by Correcting the Z Mutations on AAT Proteins The pharmacological effects of the targeted nucleotide correction of the Z mutation in PiZ transgenic mice were also analyzed. The PiZ mice do not manifest any lung emphysema symptoms due to sufficient mouse AAT expression from the endogenous SERPINA1 loci. Therefore, pulmonary function tests do not provide any insights in this current study. First, a human-specific AAT ELISA was performed to understand the kinetics of effects in terms of circulating AAT. Briefly, blood samples were collected by tail nicking at interval time points and by cardiac puncture at terminal time points. Blood was further processed into serum and kept frozen in −80'C. A human AAT ELISA Kit (ab108799, Abcam) was used to measure the absolute concentrations of human AAT in serum samples from the PiZ transgenic mice. Serum samples were thawed on ice and diluted in supplied assay buffer containing 0.01% naïve C57BL/6 mouse serum. A standard curve was prepared by reconstituting the supplied recombinant AAT as per the supplied protocol to 100 ng/ml and serial dilutions to 0.137 ng/ml. After antibody incubation and exposure steps, the plate was read on an Envision (Perkin Elmer, Santa Clara, Calif.) at the absorbance of 450 nm. A standard curve was calculated fitted to a 4-parameter sigmoidal curve (Graph Pad Prism, La Jolla Calif.) using the background corrected Absorbance values for each standard. For each serum sample, the dilution(s) lying in the linear range of the standard curve were extrapolated to generate raw values. The raw values were adjusted by multiplying by the dilution to give the actual value in serum in ng/ml. If there were two values in the linear range, both values were calculated and then averaged.

Similar to the results using the All-in-One AAV8-CRISPR vectors in Example 2, reduction of serum AAT was detected from Day 5 and stabilized from Day 14. Both dual-vector treatment groups demonstrated more than two-log reduction in the total human AAT content in blood (FIG. 21A). Due to the lack of antibodies specific to AAT-M and the low abundance of the corrected AAT-M in circulation, the percentage of circulating AAT proteins in M or Z form could not be analyzed.

Figure 21C:
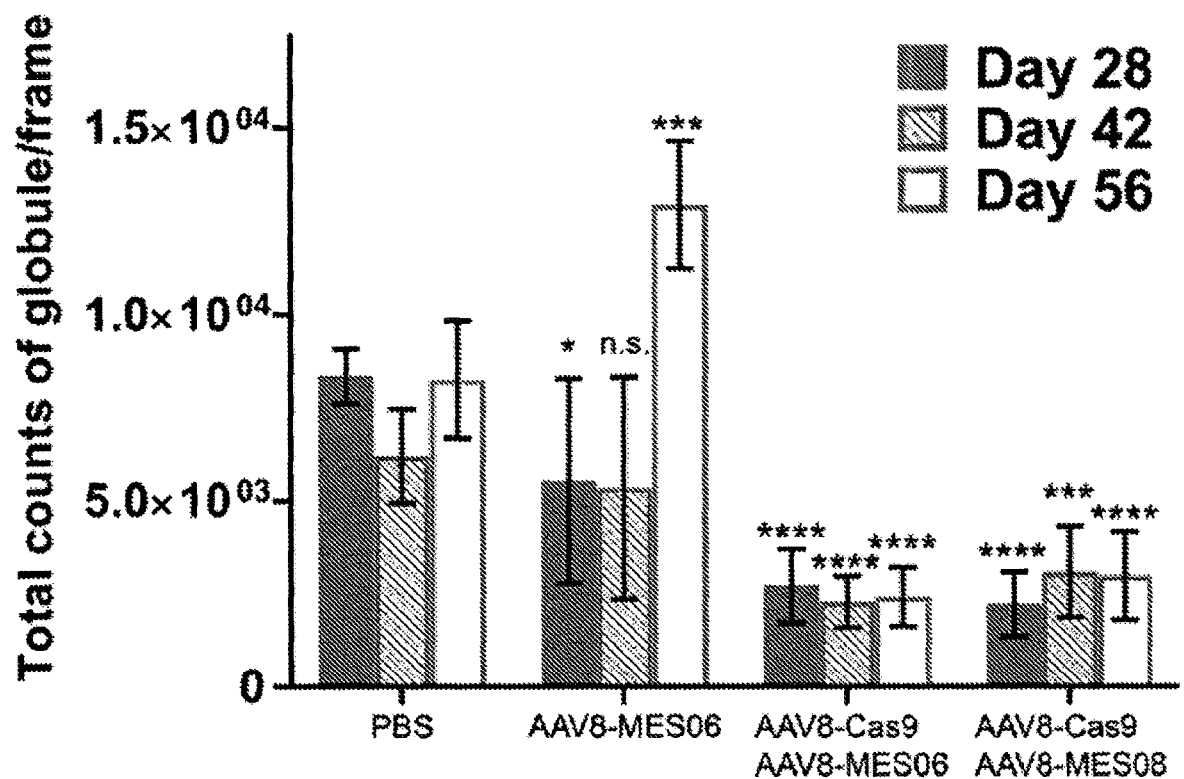
Figure 21D:
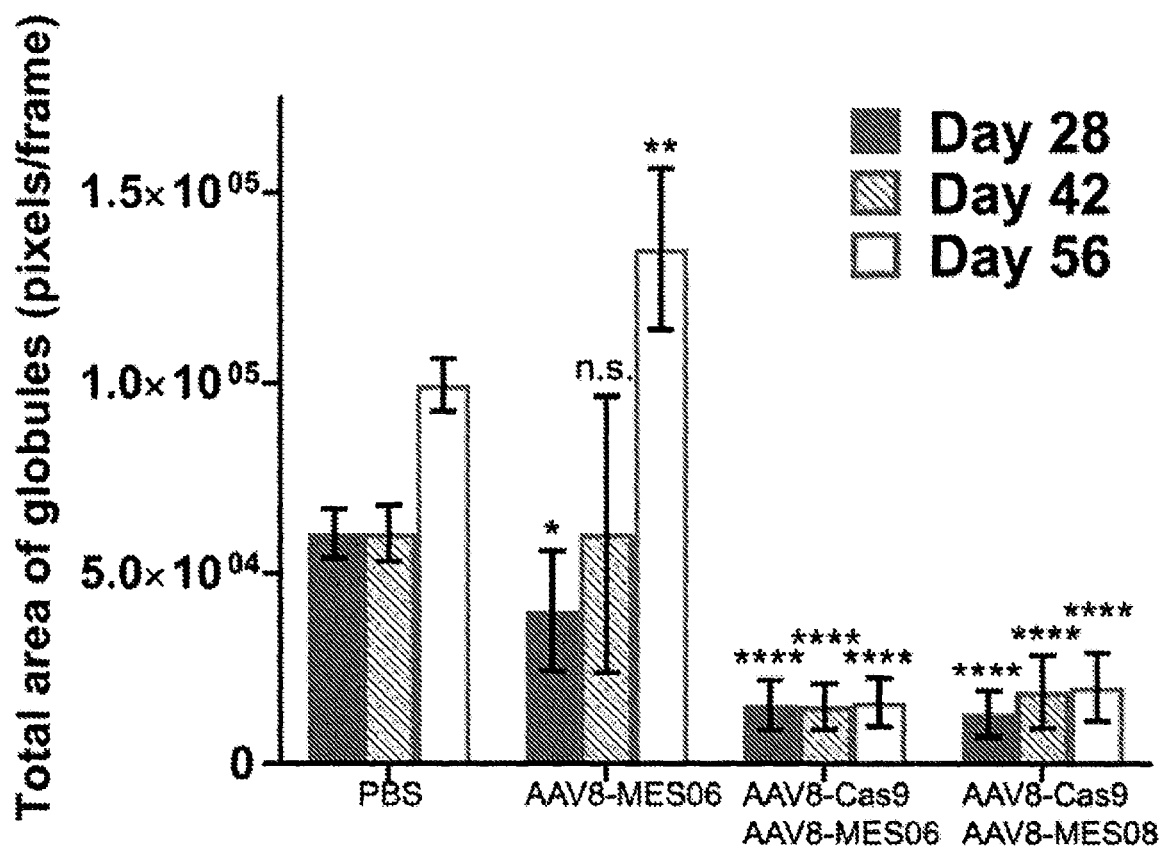

Consistent with the ELISA results, PAS-D staining of liver sections harvested at Day 56 also demonstrated robust reduction in AAT globules in hepatocytes (FIG. 21B). Briefly, liver tissues were collected, fixed in 10% buffered formalin, embedded in paraffin, and sectioned into 5 um slices. Sections were stained with PAS-D to visualize AAT aggregation in hepatocytes, followed by quantitation of globule counts and total globule area using ImageJ (Rasband W. S., National Institutes of Health, USA). Three random areas were imaged and analyzed for each liver sample. Slides of H&E staining were also imaged to visualize general morphology and AAT aggregates. Quantification of PAS-D staining images (FIGS. 24A-D) revealed that both the globule counts and sizes were reduced by more than 80% on Day 56 post injections (FIGS. 21C & 21D). Interestingly, the total globule counts and sizes increased from Day 28 to 56 in both PBS and single-vector control groups, indicating accumulation of AAT globules in PiZ hepatocytes over time. Together, these molecular and pharmacological results suggest the potential of CRISPR/Cas9-mediated gene correction to simultaneously reduce the toxic protein load in livers and increase active AAT-M content in circulation. As shown herein, the dual-vector AAV8-CRISPR system correcting the Z-mutation on Exon V ameliorated the liver injuries of PiZ mice.

In this example, two-tailed Student t tests and one-way ANOVA with Bonferroni multiple comparison post-test were performed using Excel and GraphPad Prism 7 (GraphPad, San Diego, Calif.). Statistical significance was assumed with a p-value <0.05 (*), <0.01 (), and <0.001 (*). Error bars in the figures represent s.e.m unless noted otherwise.

In certain embodiments, Cas9 protein expression in liver specimens may be analyzed by Western blotting with an antibody recognizing saCas9. Levels of hSERPINA1 and mSERPINA1 mRNA in liver samples may be quantified by RT-qPCR using species-specific primer pairs. In addition, T7E1 assay and Next Generation Sequencing may be carried out in order to study the gene editing events at the DNA level. In certain embodiments, mice may be injected intravenously with the following combination of AAV vectors carrying saCas9, gRNA, and HDR template: (1) AAV-SS99-1 ($2 \times 10^{11}$ µg/mouse); (2) AAV-MES06 ($8 \times 10^{11}$ µg/mouse); (3) AAV-SS99-1 ($2 \times 10^{11}$ µg/mouse) and AAV-MES02 ($8 \times 10^{11}$ µg/mouse); (4) AAV-SS99-1 ($2 \times 10^{11}$ µg/mouse) and AAV-MES06 ($8 \times 10^{11}$ µg/mouse); or (5) AAV-SS99-1 ($2 \times 10^{11}$ µg/mouse) and AAV-MES08 ($8 \times 10^{11}$ µg/mouse).

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

REFERENCES

Alam et al. Am J Respir Crit Care Med 189(8):909-931 (2014)
An et al. Hepatology 41(1):160-167 (2005)
Anders et al. Nature 513(7519):569-573 (2014)
Bae et al. Bioinformatics 30(10):1473-1475 (2014)
Barretina et al. Nature 483(7391):603-607 (2012)
Sandhaus et al. Chronic Obstr Pulm Dis 3(3)668-682 (2016)
Sather et al. Sci Trans Med. 7(307):307ra156 (2015)
Caldecott Nat Rev Genet 9(8):619-631 (2008)
Carlson et al. J Clin Invest 83(4):1183-1190 (1989)
Chylinski et al. RNA Biol 10(5):726-737 (2013)
Cong et al. Science 399(6121):819-823 (2013)
Cotta-Ramusino et al. WO 2016/073990 (2016)
Deveau et al. J Bacteriol 190(4):1390-1400 (2008)
Dever et al. Nature 539(7629):384-389 (2016)
Esvelt et al. Nature 472(7344):499-503 (2011)
Fine et al. Sci Rep. 5:10777 (2015)
Friedland et al. Genome Biology 16(257):1-10 (2015)
Fu et al. Nat Biotechnol 32:279-284 (2014)
Grieger et al. Nat Protoc 1(3):1412-1428 (2006)
Guilinger et al. Nat Biotechnol 32:577-582 (2014)
Haft PLoS Comput Biol 1(6):e60 (2005)
Heigwer Nat Methods 11(2): 122-123 (2014)
Horvath & Barrangou Science 327(5962):167-170 (2010)
Hsu et al. Nat Biotechnol 31(9):827-832 (2013)
Jinek et al. Science 337(6096):816-821 (2012)
Jinek et al. Science 343(6176):1247997 (2014)
Kleinstiver et al. Nature 523(7561):481-485 (2015a)
Kleinstiver et al. Nat Biotechnol 33(12):1293-1298 (2015b)
Kleinstiver et al. Nature 529(7587):490-495 (2016)
Lee et al. Nano Lett 12(12):6322-6327 (2012)
Li Cell Res 18(1):85-98 (2008)
Lindblad et al. Hepatology 46(4):1228-1235 (2007)
Makarova et al. Nat Rev Microbiol 9(6):467-477 (2011)
Mali et al. Science 339(6121):823-826 (2013)
Marteijn et al. Nat Rev Mol Cell Biol 15(7):465-481 (2014)
Mornex et al. J Clin Invest 77(6):1952-1961 (1986)
Mulgrew et al. Chest 125(5):1952-1957 (2004)
Nishimasu et al. Cell 156(5):935-949 (2014)
Ran et al. Cell 154(6):1380-1389 (2013)
Sharma et al. Blood 126(15):1777-1784 (2015)
Shmakov et al. Molecular Cell 60(3):385-397 (2015)
Sifers et al. Nucleic Acids Res 15(4):1459-1475 (1987)
Sternberg et al. Nature 507(7490):62-67 (2014)
Sveger Acta Paediatr Scand 77(6):847-851 (1988)
Volpert et al. J Pediatr Gastroenterol Nutr 31(3):258-263 (2000)
Wang et al. Cell 153(4):910-918 (2013)
Wang et al. Nature Biotechnol 33(12):1256-1263 (2015)
Wang et al. Nucleic Acids Research 44(3):e30 (2016)
Xiao et al. "CasOT: a genome-wide Cas9/gRNA off-target searching tool. Bioinformatics (epub Jan. 21, 2014)
Yamano et al. Cell 165(4): 949-962 (2016)
Zetsche et al. Nat Biotechnol 33(2):139-42 (2015)

TABLE 1

Lipids used for gene transfer

| Lipid | Abbreviation | Feature |
| --- | --- | --- |
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |

TABLE 1-continued

| Lipids used for gene transfer | | |
|---|---|---|
| Lipid | Abbreviation | Feature |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinolcyl-methyl-4-dimethylaminobutyrate | DLin-MC3-DMA | Cationic |

TABLE 2

| Cas systems | | | | | |
|---|---|---|---|---|---|
| Gene name[‡] | System type or subtype | Name from Haft 2005[§] | Structure of encoded protein (PDB accessions)[¶] | Families (and superfamily) of encoded protein[#,**] | Representatives |
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |
| cas3' | Type I[‡‡] | cas3 | NA | COG1203 | APE1232 and ygcB |
| cas3" | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A<br>Subtype III-B | cas6 and cmx6 | 3I4H | COG1583 and COG5551 (RAMP) | PF1131 and slr7014 |
| cas6e | Subtype I-E | cse3 | 1WJ9 | (RAMP) | ygcH |
| cas6f | Subtype I-F | csy4 | 2XLJ | (RAMP) | y1727 |
| cas7 | Subtype I-A<br>Subtype I-B<br>Subtype I-C<br>Subtype I-F | csa2, csd2, cse4, csh2, csp1 and cst2 | NA | COG1857 and COG3649 (RAMP) | devR and ygcJ |
| cas8a1 | Subtype I-A[‡‡] | cmx1, cst1, csx8, csx13 and CXXC-CXXC | NA | BH0338-like | LA3191[§§] and PG2018[§§] |

TABLE 2-continued

| | | | Cas systems | | |
|---|---|---|---|---|---|
| Gene name[‡] | System type or subtype | Name from Haft 2005[§] | Structure of encoded protein (PDB accessions)[¶] | Families (and superfamily) of encoded protein[#**] | Representatives |
| cas8a2 | Subtype I-A[‡‡] | csa4 and csx9 | NA | PH0918 | AF0070, AF1873, MJ0385, PF0637, PH0918 and SSO1401 |
| cas8b | Subtype I-B[‡‡] | csh1 and TM1802 | NA | BH0338-like | MTH1090 and TM1802 |
| cas8c | Subtype I-C[‡‡] | csd1 and csp2 | NA | BH0338-like | BH0338 |
| cas9 | Type II[‡‡] | csn1 and csx12 | NA | COG3513 | FTN_0757 and SPy1046 |
| cas10 | Type III[‡‡] | cmr2, csm1 and csx11 | NA | COG1353 | MTH326, Rv2823c[§§] and TM1794[§§] |
| cas10d | Subtype I-D[‡‡] | csc3 | NA | COG1353 | slr7011 |
| csy1 | Subtype I-F[‡‡] | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E[‡‡] | cse1 | NA | YgcL-like | ygcL |
| cse2 | Subtype I-E | cse2 | 2ZCA | YgcK-like | ygcK |
| csc1 | Subtype I-D | csc1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn2 | NA | SPy1049-like | SPy1049 |
| csm2 | Subtype III-A[‡‡] | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |
| cmr1 | Subtype III-B | cmr1 | NA | COG1367 (RAMP) | PF1130 |
| cmr3 | Subtype III-B | cmr3 | NA | COG1769 (RAMP) | PF1128 |
| cmr4 | Subtype III-B | cmr4 | NA | COG1336 (RAMP) | PF1126 |
| cmr5 | Subtype III-B[‡‡] | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |
| csb2 | Subtype I-U[§§] | NA | NA | (RAMP) | Balac_1305 and GSU0054 |
| csb3 | Subtype I-U | NA | NA | (RAMP) | Balac_1303[§§] |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2I71 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

TABLE 3

Component formulation, delivery, and administration strategies
Elements

| Cas9 Molecule(s) | gRNA Molecule(s) | Donor Template Nucleic Acid | Comments |
|---|---|---|---|
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided as a separate DNA molecule. |
| DNA | DNA | | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the gRNA. |
| | DNA | DNA | In this embodiment, a Cas9 molecule, typically an eaCas9 molecule, and a gRNA are transcribed from DNA, here from a single molecule. In this embodiment, the donor template is provided as a separate DNA molecule. |
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the Cas9. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided as a separate DNA molecule. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided on the same DNA molecule that encodes the Cas9. |
| mRNA | RNA | DNA | In this embodiment, a Cas9 molecule, typically an eaCas9 molecule, is translated from in vitro transcribed mRNA, and a gRNA is provided as in vitro transcribed or synthesized RNA. In this embodiment, the donor template is provided as a DNA molecule. |
| mRNA | DNA | DNA | In this embodiment, a Cas9 molecule, typically an eaCas9 molecule, is translated from in vitro transcribed mRNA, and a gRNA is transcribed from DNA. In this embodiment, the donor template is provided as a separate DNA molecule. |
| mRNA | | DNA | In this embodiment, a Cas9 molecule, typically an eaCas9 molecule, is translated from in vitro transcribed mRNA, and a gRNA is transcribed from DNA. In this embodiment, the donor template is provided on the same DNA molecule that encodes the gRNA. |
| Protein | DNA | DNA | In this embodiment, a Cas9 molecule, typically an eaCas9 molecule, is provided as a protein, and a gRNA is transcribed from DNA. In this embodiment, the donor template is provided as a separate DNA molecule. |
| Protein | | DNA | In this embodiment, a Cas9 molecule, typically an eaCas9 molecule, is provided as a protein, and a gRNA is transcribed from DNA. In this embodiment, the donor template is provided on the same DNA molecule that encodes the gRNA. |

TABLE 3-continued

Component formulation, delivery, and administration strategies
Elements

| Cas9 Molecule(s) | gRNA Molecule(s) | Donor Template Nucleic Acid | Comments |
|---|---|---|---|
| Protein | RNA | DNA | In this embodiment, an eaCas9 molecule is provided as a protein, and a gRNA is provided as transcribed or synthesized RNA. In this embodiment, the donor template is provided as a DNA molecule. |

TABLE 4

Delivery methods for RNA-guided nuclease (e.g., Cas) system components

| | Delivery Vector/Mode | Delivery into Non-Dividing Cells | Duration of Expression | Genome Integration | Type of Molecule Delivered |
|---|---|---|---|---|---|
| Physical (e.g., electroporation, particle gun, Calcium Phosphate transfection, cell compression or squeezing) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

TABLE 5

Polymers used for gene transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |

TABLE 5-continued

Polymers used for gene transfer

| Polymer | Abbreviation |
|---|---|
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

TABLE 10

S. aureus Cas9 gRNA target sequences for Exon II of hSERPINA1

| S. aureus gRNA Name Designation | S. aureus gRNA Targeting Domain Sequence | SEQ ID NO |
|---|---|---|
| SERPINA1-2-r270 | UCAGGCCCUCCAGGAUUUCAUC | 1409 |
| SERPINA1-2-r282 | UUGGGGGUGAUCUUGUUGAAGG | 1421 |
| SERPINA1-2-r746 | UUACGUGGAGAAGGGUACUCAA | 1890 |
| SERPINA1-2-r655 | AGGUUGGGUGAUCCUGAUCAUG | 1799 |
| SERPINA1-2-r558 | CAGCUGGCGGUAUAGGCUGAAG | 1701 |
| SERPINA1-2-r251 (i.e., sg230) | GGUUGGGUGAUCCUGAUCAUGG | 1390 |
| SERPINA1-2-r453 | CAAAGGCUGUAGCGAUGCUCAC | 1592 |
| SERPINA1-2-r759 | UCUCCUGGCUGAGGAUCCCCA | 1903 |
| SERPINA1-2-r667 (i.e., sg333) | AAGGCUGUAGCGAUGCUCACUG | 1811 |
| SERPINA1-2-r310 | UCACGAUGAAAUCCUGGAGGGC | 1449 |
| SERPINA1-2-r262 | GACAGAUACAUCCCACCAUGAU | 1401 |
| SERPINA1-2-r851 | GAGAUUCCGGAGGCUCAGAUCC | 1997 |
| SERPINA1-2-r798 | UGGAUUGGUCAAGGAGCUUGA | 1944 |
| SERPINA1-2-r298 | UGAAGGCGAACUCAGCCAGGUU | 1437 |
| SERPINA1-2-r323 | AACAAGAUCACCCCCAACCUGG | 1462 |
| SERPINA1-2-r706 | AAAGGCUGUAGCGAUGCUCACU | 1850 |
| SERPINA1-2-r628 | GUGUGCCAGCUGGCGGUAUAGG | 1771 |
| SERPINA1-2-r766 | CACCAAUAUCUUCUUCUCCCCA | 1910 |
| SERPINA1-2-r505 | GAUCUGAGCCUCCGGAAUCUCC | 1646 |
| SERPINA1-2-r965 | GACAAUGCCGUCUUCUGUCUCG | 2111 |
| SERPINA1-2-r959 | ACUGUCAACUUCGGGGACACCG | 2105 |
| SERPINA1-2-r932 | AGAAGCCUUCACUGUCAACUUC | 2078 |

TABLE 11

Components of expression vectors

| Name | gRNA | Promoter of saCas9 | PolyA | Length including ITRs |
|---|---|---|---|---|
| pAF003 | N/A | CMV | bGH | N/A |
| pSS79 | N/A | CMV | bGH | N/A (6702 - total) |
| pSS99-1 | N/A | TBG | bGH | 4437 |
| pSS99-4 | N/A | CMV | bGH | 4573 |
| pMES04 | gRNA-1889 | N/A | N/A | N/A (2280 - total) |
| pMES06 | gRNA-1889Z/ SERPINA1-1A-r454 | N/A | N/A | 4147 |
| pMES08 | gRNA-1889Z/ SERPINA1-1A-r454 | N/A | N/A | 4147 |
| pSS111 | N/A | CMV | bGH | N/A (4737 - total) |
| pSS111-1 | N/A | CMV | bGH | 2612 |
| pSS112 | gRNA-2-r251 (sg230) | EFS | Mini PolyA | 4491 |
| pSS113 | gRNA-2-667 (sg333) | EFS | Mini PolyA | 4491 |
| pSS114 | gRNA-2-r251 (sg230) | TBG | bGH | 4700 |
| pSS115 | gRNA-2-r667 (sg333) | TBG | bGH | 4700 |

TABLE 12

S. aureus Cas9 gRNA target sequences for Exon V of hSERPINA1

| S. aureus gRNA Name Designation | S. aureus gRNA Targeting Domain Sequences | SEQ ID NO |
|---|---|---|
| SERPINA1-1A-r164 | CUUGACCUCGGGGGGAUAGAC | 416 |
| SERPINA1-1A-r152 | GUUUGUUGAACUUGACCUCGGG | 404 |
| SERPINA1-1A-r178 | CACGUGAGCCUUGCUCGAGGCC | 430 |
| SERPINA1-1A-r174 | AGGCCUAUGUGACAGGGAGGGA | 426 |
| SERPINA1-1A-r181 | UGCAGGGCCAGGGCCGUCCAGG | 433 |
| SERPINA1-1A-r157 | GAGGAGCGAGAGGCAGUUAUUU | 409 |
| SERPINA1-1A-r155 | GCGAGAGGCAGUUAUUUUUGGG | 407 |
| SERPINA1-1A-r184 | UCCCCUCUUCAUGGGAAAAGUG | 436 |
| SERPINA1-1A-r162 | UGACCUCGGGGGGAUAGAC | 414 |
| SERPINA1-1A-r20 | UUGUUGAACUUGACCUCGGG | 272 |
| SERPINA1-1A-r307 | UCAGCACAGCCUUAUGCACGGC | 559 |
| SERPINA1-1A-r344 | GGGUUUGUUGAACUUGACCUCG | 596 |
| SERPINA1-1A-r233 | CUUAUGCACGGCCUGGAGGGGA | 485 |
| SERPINA1-1A-r406 | AAGGGUUUGUUGAACUUGACCU | 658 |
| SERPINA1-1A-r286 | CAGCACAGCCUUAUGCACGGCC | 538 |
| SERPINA1-1A-r239 | ACAGCCUUAUGCACGGCCUGGA | 491 |

TABLE 12-continued

S. aureus Cas9 gRNA target sequences for Exon V of hSERPINA1

| S. aureus gRNA Name Designation | S. aureus gRNA Targeting Domain Sequences | SEQ ID NO |
|---|---|---|
| SERPINA1-1A-r547 | GAGGUGUCCACGUGAGCCUUGC | 799 |
| SERPINA1-1889 | CUGACCAUCGACGAGAAAGGGA | 2191 |
| SERPINA1-1889Z; SERPINA1-1A-r454 | CUGACCAUCGACAAGAAAGGGA | 706 |
| SERPINA1-1A-r413 | CUUGGUAUUUUGUUCAAUCAUU | 665 |
| SERPINA1-1A-r213 | GAUUCACCACUUUUCCCAUGAA | 465 |
| SERPINA1-1A-r508 | GCCAUACCCAUGUCUAUCCCCC | 760 |
| SERPINA1-1970 | GACGAGAAAGGGACUGAAGCUG | 2192 |
| SERPINA1-1970Z; SERPINA1-1A-r603 | GACAAGAAAGGGACUGAAGCUG | 855 |
| SERPINA1-1A-r387 | GCACAGCCUUAUGCACGGCCUG | 639 |

Underlined/bolded residues correspond to Z mutation position in target domain

TABLE 13

Single-stranded oligonucleotide (ssODN) donor sequences to mediate HDR events on Exon V of hSERFINA1

| ssODN | Direction relative to chr. 14 | 5' homology arm-to-3'-homology arm asymmetry relative to the break (length of 5' homology arm: length of 3' homology arm) | Length of the 5' homology arm extending 5' from the break (nt) | Length of the 3' homology arm extending 3' from the break (nt) | ssODN sequence | Mutated proto-spacer sequence in ssODN | Left 5') homology arm sequence relative to the break | Right 3') homology arm sequence relative to the break |
|---|---|---|---|---|---|---|---|---|
| ssODN_1 | - strand; tran-scrip-tion strand | 53:46 | 88 | 77 | TCGAGGCCTGGG ATCAGCCTTACAA CGTGTCTCTGCTT CTCTCCCCTCCAG GCCGTGCATAAG GCTGTGCTCACaA TtGATAAAAAGGG CACCGAGGCTGCT GGGGCCATGTTTT TAGAGGCCATAC CCATGTCTATCCC CCCCGAGGTCAA GTTCAACAAACCC (SEQ ID NO: 2207) | CTCACA ATTGAT AAAAAG GGCA (SEQ ID NO: 2194) | TCGAGGCCT GGGATCAGC CTTACAACG TGTCTCTGC TTCTCTCCC CTCCAGGC CGTGCATA CAATTGAT AAAAAGG (nts 13909-13996 in SEQ ID NO:2231) SEQ ID NO: 2208 | GCACCGA GGCTGCT GGGGCCA TGTTTTTA GAGGCCA TACCCAT GGAGGTC AAGTTCA ACAAACCC (SEQ ID NO:2209) |
| ssODN_2 | - strand; tran-scrip-tion strand | 60:40 | 99 | 66 | GTGAGCCTTGCTC GAGGCCTGGGAT CAGCCTTACAACG TGTCTCTGCTTCT CTCCCCTCCAGGC CGTGCATAAGGCT GTGCTCACaAtGA TAAAAAGGGCAG CGAGGCTGCTGG GGCCATGTTTTTA GAGGCCATACCC ATGTCTATCCCCC CCGAGGTCAAGT (SEQ ID NO: 2210) | CTCACAA TTGATAA AAAGGG CA (SEQ ID NO: 2194) | GTGAGCCTT GCTCGAGG CCTGGGAT CAGCCTTA CAACGTGT CTCTGCTT CTCTCCCC TCCAGGCC GTGCATAA GGCTGTGC TCACAATT GATAAAA AGG (nts 13898-13966 in SEQ ID NO:2231) | GCACCGAG GCTGCTGG GGCCATGT TTTTAGAG GCCATACC CATGTCTA TCCCCCCC GAGGTCA AGT (SEQ ID NO: 2212) |

TABLE 13-continued

Single-stranded oligonucleotide (ssODN) donor sequences to mediate HDR events on Exon V of hSERFINA1

| ssODN | Direction relative to chr. 14 | 5' homology arm-to-3'-homology arm asymmetry relative to the break (length of 5' homology arm: length of 3' homology arm) | Length of the 5' homology arm extending 5' from the break (nt) | Length of the 3' homology arm extending 3' from the break (nt) | ssODN sequence | Mutated proto-spacer sequence in ssODN | Left 5') homology arm sequence relative to the break | Right 3') homology arm sequence relative to the break |
|---|---|---|---|---|---|---|---|---|
| | | | | | | | | (SEQ ID NO: 2211) |
| ssODN_3 | – strand; tran-scrip-tion strand | 40:60 | 66 | 99 | CAACGTGTCTCTG CTTCTCTCCCCTC CAGGCCGTGCAT AAGGCTGTGCTCA CaATtGATAAAAA GGGCACCGAGGC TGCTGGGCCATG TTTTTAGAGGCCA TACCCATGTCTAT CCCCCCCGAGGTC AAGTTCAACAAA CCCTTTGTCTTCT TAATGATTGAAC (SEQ ID NO: 2213) | CTCACAA TTGATA AAAAGG GCA (SEQ ID NO: 2194) | CAACGTGTC TCTGCTTC TCTCCCCT CCAGGCCG TGCATAAG GCTGTGCT CACAATTG ATAAAAAGG (nts 13931-13996 in SEQ ID NO: 2231) (SEQ ID NO: 2214) | GCACCGAG GCTGCTGG GGCCATGT TTTTAGAG GCCATACC CATGTCTA TCCCCCCC GAGGTCAA GTTCAACA AACCCTTT GTCTTCTT AATGATTG AAC (SEQ ID NO: 2215) |
| ssODN_4 | + strand; non-tran-scrip-tion strand | 46:53 | 77 | 88 | GGGTTTGTTGAAC TTGACCTCGGGGG GGATAGACATGG GTATGGCCTCTAA AAACATGGCCCC AGCAGCCTCGGT GCCCTTTTTATCa ATtGTGAGCACAG CCTTATGCACGGC CTGGAGGGGAGA GAAGCAGAGACA CGTTGTAAGGCTG ATCCCAGGCCTCGA (SEQ ID NO: 2216) | TGCCCTT TTTATCA ATTGTGAG (SEQ ID NO: 2195) | GGGTTTGTT GAACTTGAC CTCGGGGG GATAGACAT GGGTATGGC CTCTAAAAA CATGGCCCC AGCAGCCTC GGTGC (SEQ ID NO: 2217) | CCTTTTTA TCAATTGT GAGCACAG CCTTATGC ACGGCCTG GAGGGGAG AGAAGCAG AGACACGT TGTAAGGC TGATCCCA GGCCTCGA (reverse complement of nts 1309-13996 in SEQ ID NO: 2231) (SEQ ID NO: 2218) |
| ssODN_5 | + strand; non-tran-scrip-tion strand | 40:60 | 66 | 99 | ACTTGACCTCGGG GGGATAGACAT GGGTATGGCCTCT AAAAACATGGCC CCAGCAGCCTCG GTGCCCTTTTTAT CaATtGTGAGCAC AGCCTTATGCACG GCCTGGAGGGGA GAGAAGCAGAGA CAGTTGTAAGGC TGATCCCAGGCCT CGAGCAAGGCTCAC (SEQ ID NO: 2219) | TGCCCTT TTTATCA ATTGTGAG (SEQ ID NO: 2195) | ACTTGACCT CGGGGGGA TAGACATGG GTATGGCC TCTAAAAAC ATGGCCCCA GCAGCTTCA GTCCACTTG ACCTCGGGG GGATAGAC ATGGGTATG GCCTCTAAA AACATGGCC CCAGCAGCC TCGGTGC (SEQ ID NO: 2220) | CCTTTTTA TCAATTGT GAGCACAG CCTTATGC ACGGCCTG GAGGGGAG AGAAGCAG AGACACGT TGTAAGGC TGATCCCA GGCCTCGA GCAAGGCT CAC (SEQ ID NO: 2221) |

TABLE 13-continued

Single-stranded oligonucleotide (ssODN) donor sequences to mediate HDR events on Exon V of hSERFINA1

| ssODN | Direction relative to chr. 14 | 5' homology arm-to-3'-homology arm asymmetry relative to the break (length of 5' homology arm: length of 3' homology arm) | Length of the 5' homology arm extending 5' from the break (nt) | Length of the 3' homology arm extending 3' from the break (nt) | ssODN sequence | Mutated proto-spacer sequence in ssODN | Left 5') homology arm sequence relative to the break | Right 3') homology arm sequence relative to the break |
|---|---|---|---|---|---|---|---|---|
| ssODN_6 | + strand; non-transcription strand | 60:40 | 99 | 66 | GTTCAATCATTAAGAAGACAAAGGGTTTGTTGAACTTGACCTCGGGGGGATAGACATGGGTATGGCCTCTAAAAACATGGCCCCAGCAGCC*CTC*G*GTGCCCTT*[TT]*AT*Ca*AT*tGTGAGCACAGCCTTATGCACGGCCTGGAGGGGAGAGAAGCAGAGACACGTTG (SEQ ID NO: 2222) | TGCCCTTTTTATCAATTGTGAG (SEQ ID NO: 2195) | GTTCAATCATTAAGAAGACAAAGGGTTTGTTGAACTTGACCTCGGGGGGATAGACATGGGTATGGCCTCTAAAAACATGGCCCCAGCAGCCCTCGGTGC (SEQ ID NO: 2223) | CCTTTTTATCAATTGTGAGCACAGCCTTATGCACGGCCTGGAGGGGAGAGAAGCAGAGACACGTTG (SEQ ID NO: 2224) |
| ssODN_7 | + strand; non-transcription strand | 70:30 | 115 | 50 | GGAGACTTGGTATTTTGTTCAATCATTAAGAAGACAAAGGGTTTGTTGAACTTGACCTCGGGGGGATAGACATGGGTATGGCCTCTAAAAACATGGCCCCAGCAGCC*CTC*G*GT*GCCCTT*[TT]*AT*Ca*AT*t*GTGAGCACAGCCTTATGCACGGCCTGGAGGGGAGAG (SEQ ID NO: 2225) | TGCCCTTTTTATCAATTGTGAG (SEQ ID NO: 2195) | GGAGACTTGGTATTTTGTTCAATCATTAAGAAGACAAAGGGTTTGTTGAACTTGACCTCGGGGGGGATAGACATGGGTATGGCCTCTAAAAACATGGCCCCAGCAGCCTCGGTGC (SEQ ID NO: 2226) | CCTTTTTATCAATTGTGAGCACAGCCTTATGCACGGCCTGGAGGGGAGAG (SEQ ID NO: 2227) |
| ssODN_1_Z | − strand; transcription strand | 53:46 | 88 | 77 | TCGAGGCCTGGGATCAGCCTTACAACGTGTCTCTGCTTCTCTCCCCTCCAGGCCGTGCATAAGGCTGTGCT*CA*C*aA*T*tGAT*g*A*g*AA*GGGCA*CC*G*A*G*GCTGCTGGGGCCATGTTTTTAGAGGCCATACCCATGTCTATCCCCCCCGAGGTCAAGTTCAACAAACCC (SEQ ID NO: 2228) | CTCACAATTGATGAGAAGGGCA (SEQ ID NO: 2230) | TCGAGGCCTGGGATCAGCCTTACAACGTGTCTCTGCTTCTCTCCCCTCCAGGCCGTGCATAAGGCTGTGCTCACAATTGATAAAAAGG (SEQ ID NO: 2208) | GCACCGAGGCTGCTGGGGCCATGTTTTTAGAGGCCATACCCATGTCTATCCCCCCCGAGGTCAAGTTCAACAAACCC (SEQ ID NO: 2209) |

TABLE 13-continued

Single-stranded oligonucleotide (ssODN) donor sequences to mediate HDR events on Exon V of hSERFINA1

| ssODN | Direction relative to chr. 14 | 5' homology arm-to-3'-homology arm asymmetry relative to the break (length of 5' homology arm: length of 3' homology arm) | Length of the 5' homology arm extending 5' from the break (nt) | Length of the 3' homology arm extending 3' from the break (nt) | ssODN sequence | Mutated protospacer sequence in ssODN | Left 5') homology arm sequence relative to the break | Right 3') homology arm sequence relative to the break |
|---|---|---|---|---|---|---|---|---|
| ssODN_2_Z | – strand; transcription strand | 60:40 | 99 | 66 | GTGAGCCTTGCTC GAGGCCTGGGAT CAGCCTTACAACG TGTCTCTGCTTCT CTCCCCTCCAGGC CGTGCATAAGGCT GTGCT<u>C</u>AC<u>a</u>AT<u>t</u>GA T<u>g</u>A<u>g</u>AAGGGCAC*C* GA*G*GCTGCTGGG GCCATGTTTTTAG AGGCCATACCCAT GTCTATCCCCCC GAGGTCAAGT (SEQ ID NO: 2229) | CTCACAAT TGATGAGA AGGGCA (SEQ ID NO: 2230) | GTGAGCCTT GCTCGAGGC CTGGGATCA GCCTTACAA CGTGTCTCT GCTTCTCTC CCCTCCAGG CCGTGCATA AGGCTGTGC TCACAATTG ATAAAAAGG (SEQ ID NO: 2211) | GCACCGAGG CTGCTGGGG CCATGTTTT TAGAGGCCA TACCCATGT CTATCCCCC CCGAGGTCA AGT (SEQ ID NO: 2212) |

Bold and shaded: mutations on the transcription strand and mutations on the non-transcription strand resulting in "AAA" and "TTT", respectively, and encoding the Z-mutation. K342; <u>Underscore</u>: silent mutations on sgRNA targeting sequence to prevent sgRNA re-recognition and Cas9 re-cutting post HDR events; Bold and italic: silent mutations on PAM site of sgRNA-1889; <u>underscore and lowercase</u>: mutations that introduce an MfeI restriction site on the target sequence to quantify HDR efficiency using an RFLP assay, which also serve as mutations to prevent sgRNA re-recognition and Cas9 re-cutting post HDR events; bold and lowercase (only ssODN_1_Z mutation and ssODN_2_Z mutation): mutations on the transcription strand resulting in "GAG" and encoding wildtype E342.

TABLE 14

Gene modification frequencies of ssODN_1 at hSERPINA1-ExonV

| Gene Editing Events | Endonuclease Assay | Quantification Methods | |
|---|---|---|---|
| | | TOPO Cloning & Sanger Sequencing | MiSeq |
| Wild-type | N/A | 7.8% | 8.3% |
| HDR (introducing all 10 mutations) | 17.1% (RFLP) | 27.6% | 32.0% |
| NHEJ | 62.0% (T7E1) | 64.5% | 59.7% |
| Total Number of Good Reads | N/A | 76 | 114,310 |

TABLE 15

Effect of donor configuration on HDR efficiency of hSERPINA1-ExonV in Hep3B cells

| Donor | Unedited | NHEJ | HDR |
|---|---|---|---|
| No donor | 25.64% | 74.36% | 0.00% |
| ssODN_1 | 0.00% | 75.00% | 25.00% |
| ssODN_2 | 0.00% | 50.00% | 50.00% |

TABLE 16

Primers and sequences for locus PCR and qRT-PCR

| Primer Name | SEQ ID NO: | Sequence (5'->3') | Note |
|---|---|---|---|
| OliSS76 | SEQ ID NO: 2199 | CACGTGGTGTCAATCCCTGA | Locus PCR Amplifying target sequence on hSERPINA1 Exon II |
| OliSS82 | SEQ ID NO: 2200 | GCTGGTTGAGCAACCTTACC | |
| oliMES2 | SEQ ID NO: 2201 | TGCAGTTCCATGAATGGCTGC | Locus PCR Amplifying target sequence on hSERPINA1 Exon V |
| oliMES3 | SEQ ID NO: 2202 | CTTCTTGGGGACTCCAAGACAGGAC | |
| oliMES103 | SEQ ID NO: 2203 | CAAGTTCCTGGAAAATGAAGACAG | qRT-qPCR primers for hSERPINA1 |
| oliMES108 | SEQ ID NO: 2204 | ACCCAGGACGCTCTTCAGATC | |
| oliMES101 | SEQ ID NO: 2205 | TGCTATCCAGAAAACCCCTCAAA | qRT-qPCR primers for mouse B2M |
| oliMES102 | SEQ ID NO: 2206 | GGCGGGTGGAACTGTGTTAC | |

SEQUENCE LISTING (2231 sequences)

SEQ ID NO: 1 - protein, 1345 aa, Streptococcus mutans
  misc_feature (10)..(21): N-terminal RuvC-like domain
  misc_feature (759)..(766): RuvC-like domain
  misc_feature (837)..(863): HNH-like domain
  misc_feature (982)..(989): RuvC-like domain
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1368 aa, Streptococcus pyogenes [sequence omitted]

SEQ ID NO: 3 - DNA, 4107 bp, Streptococcus pyogenes
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 4 - protein, 1388 aa, Streptococcus thermophilus
  misc_feature (10)..(21): N-terminal RuvC-like domain
  misc_feature (760)..(767): RuvC-like domain
  misc_feature (844)..(870): HNH-like domain
  misc_feature (989)..(996): RuvC-like domain
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 5 - protein, 1334 aa, Listeria innocua
  misc_feature (10)..(21): N-terminal RuvC-like domain
  misc_feature (762)..(769): RuvC-like domain
  misc_feature (840)..(866): HNH-like domain
  misc_feature (985)..(992): RuvC-like domain
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 6 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 7 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 8 - DNA, 3159 bp, Staphylococcus aureus
atgaagcggaactacatcctgggcctggacatcggcatcaccagcgtgggctacggcatcatcgactacgagacacgggacgtgatcgatgccggcgtgcggctgttcaaagaggccaacgtggaaaacaacgagggcaggcggagcaagagaggcgccagaaggctgaagcggcggaggcggcatagaatccagagagtgaagaagctgctgttcgactacaacctgctgaccgaccacagcgagctgagcggcatcaacccctacgaggccagagtgaagggcctgagccagaagctgagcgaggaagagttctctgccgccctgctgcacctggccaagagaagaggcgtgcacaacgtgaacgaggtggaagaggacaccggcaacgagctgtccaccaaagagcagatcagccggaacagcaaggccctggaagagaaatacgtggccgaactgcagctggaacggctgaagaaagacggcgaagtgcggggcagcatcaacagattcaagaccagcgactacgtgaaagaagccaaacagctgctgaaggtgcagaaggcctaccaccagctggaccagagcttcatcgacacctacatcgacctgctggaaacccggcggacctactatgagggacctggcgagggcagccccttcggctggaaggacatcaaagaatggtacgagatgctgatgggccactgcacctacttccccgaggaactgcggagcgtgaagtacgcctacaacgccgacctgtacaacgccctgaacgacctgaacaatctcgtgatcaccagggacgagaacgagaagctggaatattacgagaagttccagatcatcgagaacgtgttcaagcagaagaagaagcccaccctgaagcagatcgccaaagaaatcctcgtgaacgaagaggatattaagggctacagagtgaccagcaccggcaagcccgagttcaccaacctgaaggtgtaccacgacatcaaggacattaccgcccggaaagagattattgagaacgccgagctgctggatcagattgccaagatcctgaccatctaccagagcagcgaggacatccaggaagaactgaccaatctgaactccgagctgacccaggaagagatcgagcagatctctaatctgaagggctataccggcacccacaacctgagcctgaaggccatcaacctgatcctggacgagctgtggcacaccaacgacaaccagatcgctatcttcaaccggctgaagctggtgcccaagaaggtggacctgtcccagcagaaagagatccccaccaccctggtggacgacttcatcctgagccccgtcgtgaagagaagcttcatccagagcatcaaagtgatcaacgccatcatcaagaagtacggcctgcccaacgacatcattatcgagctggcccgcgagaagaactccaaggacgcccagaaaatgatcaacgagatgcagaagcggaaccggcagaccaacgagcggatcgaggaaatcatccggaccaccggcaaagagaacgccaagtacctgatcgagaagatcaagctgcacgacatgcaggaaggcaagtgcctgtacagcctggaagccatccctctggaagatctgctgaacaaccccttcaactatgaggtggaccacatcatccccagaagcgtgtccttcgacaacagcttcaacaacaaggtgctcgtgaagcaggaagaaaacagcaagaagggcaaccggaccccattccagtacctgagcagcagcgacagcaagatcagctacgaaaccttcaagaagcacatcctgaatctggccaagggcaagggcagaatcagcaagaccaagaaagagtatctgctggaagaacgggacatcaacaggttctccgtgcagaaagacttcatcaaccggaacctggtggataccagatacgccaccagaggcctgatgaacctgctgcggagctacttcagagtgaacaacctggacgtgaaagtgaagtccatcaatggcggcttcaccagctttctgcggcggaagtggaagtttaagaaagagcggaacaaggggtacaagcaccacgccgaggacgccctgatcattgccaacgccgatttcatcttcaaagagtggaagaaactggacaaggccaaaaaagtgatggaaaaccagatgttcgaggaaaagcaggccgagagcatgcccgagatcgaaaccgagcaggagtacaaagagatcttcatcaccccccaccagatcaagcacattaaggacttcaaggactacaagtacagccaccgggtggacaagaagcctaatagagagctgattaacgacaccctgtactccacccggaaggacgacaagggcaacaccctgatcgtgaacaatctgaacggcctgtacgacaaggacaatgacaagctgaaaaagctgatcaacaagagccccgaaaagctgctgatgtaccaccacgacccccagacctaccagaaactgaagctgattatggaacagtacggcgacgagaagaatcccctgtacaagtactacgaggaaaccgggaactacctgaccaagtactccaaaaaggacaacggccccgtgatcaagaagattaagtattacggcaacaaactgaacgcccatctggacatcaccgacgactaccccaacagcagaaacaaggtcgtgaagctgtccctgaagccctacagattcgacgtgtacctggacaatggcgtgtacaagttcgtgaccgtgaagaatctggatgtgatcaaaaaagaaaactactacgaagtgaatagcaagtgctatgaggaagctaagaagctgaagaagatcagcaaccaggccgagtttatcgcctccttctacaacaacgatctgatcaagatcaacggcgagctgtatagagtgatcggcgtgaacaacgacctgctgaaccggatcgaagtgaacatgatcgacatcacctaccgcgagtacctggaaaacatgaacgacaagaggccccccaggatcattaagacaatcgcctccaagacccagagcattaagaagtacagcacagacattctgggcaacctgtatgaagtgaaatctaagaagcaccctcagatcatcaaaaagggc

SEQ ID NO: 9 - DNA, 3159 bp, Staphylococcus aureus
atgaagcgcaactacatcctcggactggacatcggcattacctccgtgggatacggcatcatcgattacgaaactagggatgtgatcgacgctggagtcaggctgttcaaagaggcgaacgtggagaacaacgaggggcggcgctcaaagaggggggcccgccggctgaagcgccgccgcagacatagaatccagcgcgtgaagaagctgctgttcgactacaaccttctgaccgaccactccgaactttccggcatcaacccatatgaggctagagtgaagggattgtcccaaaagctgtccgaggaagagttctccgccgcgttgctccacctcgccaagcgcaggggagtgcacaatgtgaacgaagtggaagaagataccggaaacgagctgtccaccaaggagcagatcagccggaactccaaggccctggaagagaaatacgtggcggaactgcaactggagcggctgaagaaagacggagaagtgcgcggctcgatcaaccgcttcaagacctcggactacgtgaaggaggccaagcagctcctgaaagtgcaaaaggcctatcaccaacttgaccagtcctttatcgatacctacatcgatctgctcgagactcggcggacttactacgagggtccaggggagggctccccatttggttggaaggatattaaggagtggtacgaaatgctgatgggacactgcacatacttccctgaggagctgcggagcgtgaaatacgcatacaacgcagacctgtacaacgcgctgaacgacctgaacaatctcgtgatcacccgggacgagaacgaaaagctcgagtattacgaaaagttccagattattgagaacgtgttcaaacagaagaagaagccgacactgaagcagattgccaaggaaatcctcgtgaacgaagaggacatcaagggctatcgagtgacctcaacgggaaagccggagttcaccaatctgaaggtctaccacgacatcaaagacattaccgcccggaaggagatcattgagaacgcggagctgttggaccagattgcgaagattctgaccatctaccaatcctccgaggatattcaggaagaactcaccaacctcaacagcgaactgacccaggaggagatagagcaaatctccaacctgaagggctacaccggaactcataacctgagcctgaaggccatcaacttgatcctggacgagctgtggcacaccaacgataaccagatcgctattttcaatcggctgaagctggtccccaagaaagtggacctctcacaacaaaaggagatccctactacccttgtggacgatttcattctgtcccccgtggtcaagagaagcttcatacagtcaatcaaagtgatcaatgccattatcaagaaatacggtctgcccaacgacattatcattgagctcgcccgcgagaagaactcgaaggacgcccagaagatgattaacgaaatgcagaagaggaaccgacagactaacgaacggatcgaagaaatcatccggaccaccgggaaggaaaacgcgaagtacctgatcgaaaagatcaagctccatgacatgcaggaaggaaagtgtctgtactcgctggaggccattccgctggaggacttgctgaacaacccttttaactacgaagtggatcatatcattccgaggagcgtgtcattcgacaattccttcaacaacaaggtcctcgtgaagcaggaggaaaactcgaagaagggaaaccgcacgccgttccagtacctgagcagcagcgactccaagatttcctacgaaaccttcaagaagcacatcctcaacctggcaaaggggaagggtcgcatctccaagaccaagaaggaatatctgctggaagaaagagacatcaacagattctccgtgcaaaaggacttcatcaaccgcaacctcgtggatactagatacgctactcggggtctgatgaacctcctgagaagctactttagagtgaacaatctggacgtgaaggtcaagtcgattaacggaggtttcacctccttcctgcggcgcaagtggaagttcaagaaggaacggaacaagggctacaagcaccacgccgaggacgccctgatcattgccaacgccgacttcatcttcaaagaatggaagaaacttgacaaggctaagaaggtcatggaaaaccagatgttcgaagaaaagcaggccgagtctatgcctgaaatcgagactgaacaggagtacaaggaaatctttattacgccacaccagatcaaacacatcaaggatttcaaggattacaagtactcacatcgcgtggacaaaaagccgaacagggaactgatcaacgacaccctctactccacccggaaggatgacaaagggaataccctcatcgtcaacaaccttaacggcctgtacgacaaggacaacgataagctgaagaagctcattaacaagtcgcccgaaaagttgctgatgtaccaccacgaccctcagacttaccagaagctcaagctgatcatggagcagtatggggacgagaaaaacccgttgtacaagtactacgaagaaactgggaattatctgactaagtactccaagaaagataacggccccgtgattaagaagattaagtactacggcaacaagctgaacgcccatctggacatcaccgatgactaccctaattcccgcaacaaggtcgtcaagctgagcctcaagccctaccggtttgatgtgtaccttgacaatggagtgtacaagttcgtgactgtgaagaaccttgacgtgatcaagaaggagaactactacgaagtcaactccaagtgctacgaggaagcaaagaagttgaagaagatctcgaaccaggccgagttcattgcctccttctataacaacgacctgattaagatcaacggcgaactgtaccgcgtcattggcgtgaacaacgatctcctgaaccgcatcgaagtgaacatgatcgacatcacttaccgggaatacctggagaatatgaacgacaagcgcccgccccggatcattaagactatcgcctcaaagacccagtcgatcaagaagtacagcaccgacatcctgggcaacctgtacgaggtcaaatcgaagaagcacccccagatcatcaagaaggga

SEQ ID NO: 10 - DNA, 3159 bp, Staphylococcus aureus
atgaaaaggaactacattctggggctggccatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 11 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagaggcctctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 12 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 13 - DNA, 3249 bp, Neisseria meningitidis
  misc_feature (1)..(3249): Exemplary codon optimized Cas9
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 14 - protein, 859 aa, Artificial Sequence
  Synthetic Cas9 consensus sequence derived from Sm, Sp, St, and Li Cas9 sequences
  misc_feature (4)..(4): Xaa can be any naturally occurring amino acid
  misc_feature (8)..(18): N-terminal RuvC-like domain
  misc_feature (21)..(21): Xaa can be any naturally occurring amino acid
  misc_feature (23)..(23): Xaa can be any naturally occurring amino acid
  misc_feature (24)..(24): Xaa can be any naturally occurring amino acid
  misc_feature (26)..(26): Xaa can be any naturally occurring amino acid
  misc_feature (29)..(31): Each Xaa can independently be any naturally occurring amino acid
  misc_feature (33)..(33): Xaa can be any naturally occurring amino acid
  misc_feature (36)..(36): Xaa can be any naturally occurring amino acid
  misc_feature (45)..(45): Xaa can be any naturally occurring amino acid
  misc_feature (54)..(54): Xaa can be any naturally occurring amino acid
  misc_feature (63)..(63): Xaa can be any naturally occurring amino acid
  misc_feature (71)..(71): Xaa can be any naturally occurring amino acid
  misc_feature (75)..(75): Xaa can be any naturally occurring amino acid
  misc_feature (76)..(76): Xaa can be any naturally occurring amino acid
  misc_feature (78)..(80): Each Xaa can independently be any naturally occurring amino acid
  misc_feature (82)..(82): Xaa can be any naturally occurring amino acid
  misc_feature (84)..(84): Xaa can be any naturally occurring amino acid
  misc_feature (85)..(85): Xaa can be any naturally occurring amino acid
  misc_feature (89)..(89): Xaa can be any naturally occurring amino acid
  misc_feature (90)..(90): Xaa can be any naturally occurring amino acid
  misc_feature (98)..(98): Xaa can be any naturally occurring amino acid
  misc_feature (100)..(100): Xaa can be any naturally occurring amino acid
  misc_feature (106)..(106): Xaa can be any naturally occurring amino acid
  misc_feature (113)..(113): Xaa can be any naturally occurring amino acid
  misc_feature (116)..(116): Xaa can be any naturally occurring amino acid
  misc_feature (125)..(125): Xaa can be any naturally occurring amino acid
  misc_feature (126)..(126): Xaa can be any naturally occurring amino acid
  misc_feature (128)..(133): Each Xaa can independently be any naturally occurring amino acid
  misc_feature (135)..(135): Xaa can be any naturally occurring amino acid
  misc_feature (137)..(137): Xaa can be any naturally occurring amino acid
  misc_feature (139)..(147): Each Xaa can independently be any naturally occurring amino acid
  misc_feature (153)..(155): Each Xaa can independently be any naturally occurring amino acid
  misc_feature (157)..(157): Xaa can be any naturally occurring amino acid
  misc_feature (159)..(159): Xaa can be any naturally occurring amino acid
  misc_feature (161)..(161): Xaa can be any naturally occurring amino acid
  misc_feature (163)..(163): Xaa can be any naturally occurring amino acid
  misc_feature (166)..(168): Each Xaa can independently be any naturally occurring amino acid
  misc_feature (170)..(170): Xaa can be any naturally occurring amino acid
  misc_feature (171)..(171): Xaa can be any naturally occurring amino acid
  misc_feature (173)..(175): Each Xaa can independently be any naturally occurring amino acid
  misc_feature (177)..(177): Xaa can be any naturally occurring amino acid
  misc_feature (183)..(183): Xaa can be any naturally occurring amino acid
  misc_feature (185)..(187): Each Xaa can independently be any naturally occurring amino acid
  misc_feature (189)..(189): Xaa can be any naturally occurring amino acid
  misc_feature (192)..(195): Each Xaa can independently be any naturally occurring amino acid
  misc_feature (198)..(198): Xaa can be any naturally occurring amino acid
  misc_feature (199)..(199): Xaa can be any naturally occurring amino acid
  misc_feature (202)..(202): Xaa can be any naturally occurring amino acid
  misc_feature (206)..(206): Xaa can be any naturally occurring amino acid
  misc_feature (207)..(207): Xaa can be any naturally occurring amino acid
  misc_feature (210)..(210): Xaa can be any naturally occurring amino acid
  misc_feature (212)..(212): Xaa can be any naturally occurring amino acid
  misc_feature (213)..(213): Xaa can be any naturally occurring amino acid
  misc_feature (219)..(219): Xaa can be any naturally occurring amino acid
  misc_feature (220)..(220): Xaa can be any naturally occurring amino acid
  misc_feature (222)..(222): Xaa can be any naturally occurring amino acid
  misc_feature (224)..(224): Xaa can be any naturally occurring amino acid
  misc_feature (226)..(226): Xaa can be any naturally occurring amino acid
  misc_feature (236)..(236): Xaa can be any naturally occurring amino acid
  misc_feature (240)..(240): Xaa can be any naturally occurring amino acid
  misc_feature (241)..(241): Xaa can be any naturally occurring amino acid
  misc_feature (244)..(246): Each Xaa can independently be any naturally occurring amino acid
  misc_feature (248)..(248): Xaa can be any naturally occurring amino acid
  misc_feature (249)..(249): Xaa can be any naturally occurring amino acid
  misc_feature (250)..(250): Xaa can be any naturally occurring amino acid
  misc_feature (252)..(254): Each Xaa can independently be any naturally occurring amino acid
  misc_feature (256)..(256): Xaa can be any naturally occurring amino acid
  misc_feature (257)..(257): Xaa can be any naturally occurring amino acid
  misc_feature (268)..(268): Xaa can be any naturally occurring amino acid
  misc_feature (271)..(271): Xaa can be any naturally occurring amino acid
  misc_feature (273)..(273): Xaa can be any naturally occurring amino acid
  misc_feature (277)..(277): Xaa can be any naturally occurring amino acid
  misc_feature (280)..(280): Xaa can be any naturally occurring amino acid
  misc_feature (281)..(281): Xaa can be any naturally occurring amino acid
  misc_feature (283)..(283): Xaa can be any naturally occurring amino acid
  misc_feature (289)..(289): Xaa can be any naturally occurring amino acid
  misc_feature (290)..(290): Xaa can be any naturally occurring amino acid
  misc_feature (292)..(294): Each Xaa can independently be any naturally occurring amino acid
  misc_feature (301)..(301): Xaa can be any naturally occurring amino acid
  misc_feature (308)..(308): Xaa can be any naturally occurring amino acid
  misc_feature (319)..(322): Each Xaa can independently be any naturally occurring amino acid
  misc_feature (328)..(328): Xaa can be any naturally occurring amino acid
  misc_feature (329)..(329): Xaa can be any naturally occurring amino acid
  misc_feature (335)..(337): Each Xaa can independently be any naturally occurring amino acid
  misc_feature (346)..(346): Xaa can be any naturally occurring amino acid
  misc_feature (347)..(347): Xaa can be any naturally occurring amino acid
  misc_feature (356)..(361): Each Xaa can independently be any naturally occurring amino acid
  misc_feature (363)..(363): Xaa can be any naturally occurring amino acid
  misc_feature (370)..(373): Each Xaa can independently be any naturally occurring amino acid
  misc_feature (375)..(375): Xaa can be any naturally occurring amino acid
  misc_feature (376)..(376): Xaa can be any naturally occurring amino acid
  misc_feature (379)..(379): Xaa can be any naturally occurring amino acid
  misc_feature (386)..(390): Each Xaa can independently be any naturally occurring amino acid
  misc_feature (393)..(393): Xaa can be any naturally occurring amino acid
  misc_feature (395)..(395): Xaa can be any naturally occurring amino acid
  misc_feature (396)..(396): Xaa can be any naturally occurring amino acid
  misc_feature (398)..(398): Xaa can be any naturally occurring amino acid
  misc_feature (400)..(400): Xaa can be any naturally occurring amino acid
  misc_feature (403)..(403): Xaa can be any naturally occurring amino acid
  misc_feature (407)..(407): Xaa can be any naturally occurring amino acid
  misc_feature (410)..(410): Xaa can be any naturally occurring amino acid
  misc_feature (411)..(411): Xaa can be any naturally occurring amino acid
  misc_feature (413)..(416): Each Xaa can independently be any naturally occurring amino acid
  misc_feature (418)..(418): Xaa can be any naturally occurring amino acid
  misc_feature (422)..(422): Xaa can be any naturally occurring amino acid
  misc_feature (428)..(428): Xaa can be any naturally occurring amino acid
  misc_feature (431)..(431): Xaa can be any naturally occurring amino acid
  misc_feature (433)..(433): Xaa can be any naturally occurring amino acid
  misc_feature (437)..(439): Each Xaa can independently be any naturally occurring amino acid
  misc_feature (445)..(445): Xaa can be any naturally occurring amino acid
  misc_feature (451)..(451): Xaa can be any naturally occurring amino acid
  misc_feature (456)..(456): Xaa can be any naturally occurring amino acid
  misc_feature (459)..(459): Xaa can be any naturally occurring amino acid
  misc_feature (465)..(469): Each Xaa can independently be any naturally occurring amino acid
  misc_feature (481)..(481): Xaa can be any naturally occurring amino acid
  misc_feature (482)..(482): Xaa can be any naturally occurring amino acid
  misc_feature (484)..(484): Xaa can be any naturally occurring amino acid
  misc_feature (490)..(490): Xaa can be any naturally occurring amino acid
  misc_feature (494)..(494): Xaa can be any naturally occurring amino acid
  misc_feature (495)..(502): RuvC-like domain
  misc_feature (497)..(497): Xaa can be any naturally occurring amino acid
  misc_feature (506)..(506): Xaa can be any naturally occurring amino acid
  misc_feature (510)..(510): Xaa can be any naturally occurring amino acid
  misc_feature (513)..(513): Xaa can be any naturally occurring amino acid
  misc_feature (514)..(514): Xaa can be any naturally occurring amino acid
  misc_feature (517)..(517): Xaa can be any naturally occurring amino acid
  misc_feature (520)..(520): Xaa can be any naturally occurring amino acid
  misc_feature (525)..(525): Xaa can be any naturally occurring amino acid
  misc_feature (526)..(526): Xaa can be any naturally occurring amino acid
  misc_feature (529)..(529): Xaa can be any naturally occurring amino acid
  misc_feature (531)..(531): Xaa can be any naturally occurring amino acid
  misc_feature (532)..(532): Xaa can be any naturally occurring amino acid
  misc_feature (534)..(534): Xaa can be any naturally occurring amino acid
  misc_feature (542)..(542): Xaa can be any naturally occurring amino acid
  misc_feature (546)..(546): Xaa can be any naturally occurring amino acid
  misc_feature (547)..(547): Xaa can be any naturally occurring amino acid
  misc_feature (553)..(553): Xaa can be any naturally occurring amino acid
  misc_feature (555)..(575): HNH-like domain
  misc_feature (556)..(556): Xaa can be any naturally occurring amino acid
  misc_feature (560)..(560): Xaa can be any naturally occurring amino acid
  misc_feature (563)..(563): Xaa can be any naturally occurring amino acid
  misc_feature (565)..(565): Xaa can be any naturally occurring amino acid
  misc_feature (567)..(567): Xaa can be any naturally occurring amino acid
  misc_feature (579)..(579): Xaa can be any naturally occurring amino acid
  misc_feature (582)..(582): Xaa can be any naturally occurring amino acid
  misc_feature (583)..(583): Xaa can be any naturally occurring amino acid
  misc_feature (585)..(585): Xaa can be any naturally occurring amino acid
  misc_feature (588)..(588): Xaa can be any naturally occurring amino acid
  misc_feature (590)..(590): Xaa can be any naturally occurring amino acid
  misc_feature (592)..(592): Xaa can be any naturally occurring amino acid
  misc_feature (594)..(596): Each Xaa can independently be any naturally occurring amino acid
  misc_feature (610)..(610): Xaa can be any naturally occurring amino acid
  misc_feature (616)..(616): Xaa can be any naturally occurring amino acid
  misc_feature (628)..(628): Xaa can be any naturally occurring amino acid
  misc_feature (631)..(631): Xaa can be any naturally occurring amino acid
  misc_feature (633)..(633): Xaa can be any naturally occurring amino acid
  misc_feature (634)..(634): Xaa can be any naturally occurring amino acid
  misc_feature (636)..(636): Xaa can be any naturally occurring amino acid
  misc_feature (638)..(641): Each Xaa can independently be any naturally occurring amino acid
  misc_feature (643)..(645): Each Xaa can independently be any naturally occurring amino acid
  misc_feature (653)..(653): Xaa can be any naturally occurring amino acid
  misc_feature (657)..(657): Xaa can be any naturally occurring amino acid
  misc_feature (659)..(659): Xaa can be any naturally occurring amino acid
  misc_feature (660)..(660): Xaa can be any naturally occurring amino acid
  misc_feature (665)..(665): Xaa can be any naturally occurring amino acid
  misc_feature (666)..(666): Xaa can be any naturally occurring amino acid
  misc_feature (668)..(668): Xaa can be any naturally occurring amino acid
  misc_feature (669)..(669): Xaa can be any naturally occurring amino acid
  misc_feature (670)..(677): RuvC-like domain
  misc_feature (680)..(680): Xaa can be any naturally occurring amino acid
  misc_feature (681)..(681): Xaa can be any naturally occurring amino acid
  misc_feature (683)..(683): Xaa can be any naturally occurring amino acid
  misc_feature (686)..(686): Xaa can be any naturally occurring amino acid
  misc_feature (696)..(696): Xaa can be any naturally occurring amino acid
  misc_feature (697)..(697): Xaa can be any naturally occurring amino acid
  misc_feature (704)..(704): Xaa can be any naturally occurring amino acid
  misc_feature (708)..(708): Xaa can be any naturally occurring amino acid
  misc_feature (710)..(710): Xaa can be any naturally occurring amino acid
  misc_feature (711)..(711): Xaa can be any naturally occurring amino acid
  misc_feature (714)..(714): Xaa can be any naturally occurring amino acid
  misc_feature (717)..(720): Each Xaa can independently be any naturally occurring amino acid
  misc_feature (722)..(722): Xaa can be any naturally occurring amino acid
  misc_feature (725)..(725): Xaa can be any naturally occurring amino acid
  misc_feature (727)..(727): Xaa can be any naturally occurring amino acid
  misc_feature (733)..(735): Each Xaa can independently be any naturally occurring amino acid
  misc_feature (740)..(740): Xaa can be any naturally occurring amino acid
  misc_feature (742)..(742): Xaa can be any naturally occurring amino acid
  misc_feature (749)..(754): Each Xaa can independently be any naturally occurring amino acid
  misc_feature (758)..(761): Each Xaa can independently be any naturally occurring amino acid
  misc_feature (763)..(768): Each Xaa can independently be any naturally occurring amino acid
  misc_feature (771)..(771): Xaa can be any naturally occurring amino acid
  misc_feature (774)..(777): Each Xaa can independently be any naturally occurring amino acid
  misc_feature (782)..(782): Xaa can be any naturally occurring amino acid
  misc_feature (784)..(786): Each Xaa can independently be any naturally occurring amino acid
  misc_feature (788)..(788): Xaa can be any naturally occurring amino acid
  misc_feature (790)..(790): Xaa can be any naturally occurring amino acid
  misc_feature (795)..(795): Xaa can be any naturally occurring amino acid
  misc_feature (799)..(799): Xaa can be any naturally occurring amino acid
  misc_feature (801)..(801): Xaa can be any naturally occurring amino acid
  misc_feature (802)..(802): Xaa can be any naturally occurring amino acid
  misc_feature (804)..(804): Xaa can be any naturally occurring amino acid
  misc_feature (806)..(813): Each Xaa can independently be any naturally occurring amino acid
  misc_feature (815)..(818): Each Xaa can independently be any naturally occurring amino acid
  misc_feature (820)..(820): Xaa can be any naturally occurring amino acid
  misc_feature (823)..(827): Each Xaa can independently be any naturally occurring amino acid
  misc_feature (829)..(829): Xaa can be any naturally occurring amino acid
  misc_feature (830)..(830): Xaa can be any naturally occurring amino acid
  misc_feature (832)..(832): Xaa can be any naturally occurring amino acid
  misc_feature (835)..(837): Each Xaa can independently be any naturally occurring amino acid
  misc_feature (842)..(844): Each Xaa can independently be any naturally occurring amino acid
  misc_feature (846)..(846): Xaa can be any naturally occurring amino acid
  misc_feature (848)..(848): Xaa can be any naturally occurring amino acid
  misc_feature (851)..(851): Xaa can be any naturally occurring amino acid
  misc_feature (857)..(857): Xaa can be any naturally occurring amino acid
  misc_feature (857)..(857): Xaa can be any naturally occurring amino acid
MKYXIGLDIGTNSVGWAVTDXYXXKXKGXXXIXKNXGLFDGTARXRTARRRRRXNRIYLQIFXEMDFFRLXSFVXXKXXXPXFXXEYHXXPTIYHLRXLXKDLRLXYLALAHXIKXRGNFLIEGXXNXXXXXXYXFXIXXXXXXXXXPEKGFXXXLXGXFXFXLEXXXKXXYXXXLXLLIGDXYXXXFXAKXXXXLSXXVTXALSXXMIXRXXHDLLKXXYXEXFXKGYAGYIDGXQFYXXKLXXXGXXXKXXXEXXLRKQRTFDNGXIPXQXHLEXAIXXQXYPFLNXXIXXXTFRIPYXVGPLAGXSFAWRKIPWNXXXXDSAFIXXMTDLPXXXVLPKHSLYXXVYNELTKVXXXXXXKXIFKRKVXXXXGXXFNXSTYHDLXXXXXLDXNXXEXIXLTXFEDXMIXXLXXXXKXLRRXYTGWGXLSXLXGIRXXXSTILDXLDNRNXMQLIXDLXFKIKQXXXXXGSPAIKKGILQXXKXVDELVXMGPXIVXEMARENQTXGNSXRKXXKEXGSXILKEXXNLXNXXLXLYYLQNGXDMYXXLDILSXYDXDHIXPQXFXDXSIDNVLSNRKDXVPXXVXKKXWXLXLXXXRKFDLTKAERGGLXDKAFIXRQLVETRQITKXVAXLXXNXDXXXXVXXXTLKSLVSXFRKXFXXLYKVXXNXXHHAHDAYLNVXXLXYPXLEEFVYGDYXXKATKFYXNIMXFXXGEXWKXXXXVXMQXNXVKKEQXXXPKNSXLXKDKYGGXXXXXXKGKXXXXIXXXXXXFLXGYXXXXLPKYXLXXXGXRXLASEXKGNXLXXLXAXXXXXXXXEXXXXFXANXXXXXLXXGXAFXXXIRRYXXXTXIXQSXTGLYEXRL

SEQ ID NO: 15 - protein, 8 aa, Artificial Sequence
  RuvC-like domain
  VARIANT (2)..(2): Xaa is Val or His
  VARIANT (3)..(3): Xaa is Ile, Leu, or Val
  VARIANT (5)..(5): Xaa is Met or Thr
IXXEXARE

SEQ ID NO: 16 - protein, 8 aa, Artificial Sequence
  RuvC-like domain
  VARIANT (3)..(3): Xaa is Ile, Leu, or Val
IVXEMARE

SEQ ID NO: 17 - protein, 8 aa, Artificial Sequence
  RuvC-like domain
  VARIANT (4)..(4): Xaa is His or Leu
  VARIANT (7)..(7): Xaa is Arg or Val
  VARIANT (8)..(8): Xaa is Glu or Val
HHAXDAXX

SEQ ID NO: 18 - protein, 8 aa, Artificial Sequence
  RuvC-like domain
HHAHDAYL

SEQ ID NO: 19 - protein, 30 aa, Artificial Sequence
  N-terminal RuvC-like domain
  VARIANT (2)..(2): Xaa is Lys or Pro
  VARIANT (4)..(4): Xaa is Val, Leu, Ile, or Phe
  VARIANT (5)..(5): Xaa is Gly, Ala, or Ser
  VARIANT (6)..(6): Xaa is Leu, Ile, Val, or Phe
  MOD_RES (7)..(26): N-terminal RuvC-like domain, each Xaa can be any amino acid or absent, region may encompass 5-20 residues
  VARIANT (29)..(29): Xaa is Asp, Glu, Asn, or Gln
KXYXXXXXXXXXXXXXXXXXXXXXXXTDXY

SEQ ID NO: 20 - protein, 12 aa, Artificial Sequence
  N-terminal RuvC-like domain
  VARIANT (2)..(2): Xaa is Ile, Val, Met, Leu, or Thr
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (6)..(6): Xaa is Ser, Tyr, Asn, or Phe
  VARIANT (7)..(7): Xaa is Val, Ile, Leu, Cys, Thr, or Phe
  VARIANT (9)..(9): Xaa is Trp, Phe, Val, Tyr, Ser, or Leu
  VARIANT (10)..(10): Xaa is Ala, Ser, Cys, Val, or Gly
  VARIANT (11)..(11): Xaa is Val, Ile, Leu, Ala, Met, or His
  VARIANT (12)..(12): Any amino acid or absent
DXGXXXXGXXXX

SEQ ID NO: 21 - protein, 12 aa, Artificial Sequence
  N-terminal RuvC-like domain
  VARIANT (2)..(2): Xaa is Ile, Val, Met, Leu, or Thr
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (7)..(7): Xaa is Val, Ile, Leu, Cys, Thr, or Phe
  VARIANT (9)..(9): Xaa is Trp, Phe, Val, Tyr, Ser, or Leu
  VARIANT (10)..(10): Xaa is Ala, Ser, Cys, Val, or Gly
  VARIANT (11)..(11): Xaa is Val, Ile, Leu, Ala, Met, or His
  VARIANT (12)..(12): Any amino acid or absent
DXGXXSXGXXXX

SEQ ID NO: 22 - protein, 12 aa, Artificial Sequence
  N-terminal RuvC-like domain
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (11)..(11): Xaa is Val, Ile, Leu, Ala, Met, or His
  VARIANT (12)..(12): Any amino acid or absent
DIGXXSVGWAXX

SEQ ID NO: 23 - protein, 12 aa, Artificial Sequence
  N-terminal RuvC-like domain
  MOD_RES (12)..(12): Any non-polar alkyl amino acid or a hydroxyl amino acid
DIGTNSVGWAVX

SEQ ID NO: 24 - protein, 73 aa, Artificial Sequence
  HNH-like domain
  VARIANT (8)..(8): Xaa is Lys or Arg
  VARIANT (12)..(12): Xaa is Val or Thr
  VARIANT (13)..(13): Xaa is Gly or Asp
  VARIANT (14)..(14): Xaa is Glu, Gln, or Asp
  VARIANT (15)..(15): Xaa is Glu or Asp
  VARIANT (19)..(19): Xaa is Asp, Asn, or His
  VARIANT (20)..(20): Xaa is Tyr, Arg, or Asn
  VARIANT (23)..(23): Xaa is Gln, Asp, or Asn
  MOD_RES (25)..(64): HNH-like domain, each Xaa can be any amino acid or absent, region may encompass 15-40 residues
  VARIANT (67)..(67): Xaa is Gly or Glu
  VARIANT (69)..(69): Xaa is Ser or Gly
  VARIANT (71)..(71): Xaa is Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 25 - protein, 27 aa, Artificial Sequence
  HNH-like domain
  VARIANT (1)..(1): Xaa is Asp, Glu, Gln, or Asn
  VARIANT (2)..(2): Xaa is Leu, Ile, Arg, Gln, Val, Met, or Lys
  VARIANT (3)..(3): Xaa is Asp or Glu
  VARIANT (5)..(5): Xaa is Ile, Val, Thr, Ala, or Leu
  VARIANT (6)..(6): Xaa is Val, Tyr, Ile, Leu, Phe, or Trp
  VARIANT (8)..(8): Xaa is Gln, His, Arg, Lys, Tyr, Ile, Leu, Phe, or Trp
  VARIANT (9)..(9): Xaa is Ser, Ala, Asp, Thr, or Lys
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (13)..(13): Xaa is Asp, Ser, Asn, Arg, Leu, or Thr
  VARIANT (14)..(14): Xaa is Asp, Asn, or Ser
  VARIANT (15)..(15): Xaa is Ser, Ala, Thr, Gly, or Arg
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (19)..(19): Xaa is Lys, Leu, Arg, Met, Thr, or Phe
  VARIANT (20)..(20): Xaa is Val, Leu, Ile, Ala, or Thr
  VARIANT (21)..(21): Xaa is Leu, Ile, Val, or Ala
  VARIANT (22)..(22): Xaa is Thr, Val, Cys, Glu, Ser, or Ala
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XXXHXXPXXXXXXXXXXNXXXXXXXXN

SEQ ID NO: 26 - protein, 27 aa, Artificial Sequence
  HNH-like domain
  VARIANT (1)..(1): Xaa is Asp or Glu
  VARIANT (2)..(2): Xaa is Leu, Ile, Arg, Gln, Val, Met, or Lys
  VARIANT (3)..(3): Xaa is Asp or Glu
  VARIANT (5)..(5): Xaa is Ile, Val, Thr, Ala, or Leu
  VARIANT (6)..(6): Xaa is Val, Tyr, Ile, Leu, Phe, or Trp
  VARIANT (8)..(8): Xaa is Gln, His, Arg, Lys, Tyr, Ile, Leu, Phe, or Trp
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (22)..(22): Xaa is Thr, Val, Cys, Glu, Ser, or Ala
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XXXHXXPXSXXXDDSXXNKVLXXXXXN

SEQ ID NO: 27 - protein, 27 aa, Artificial Sequence
  HNH-like domain
  VARIANT (1)..(1): Xaa is Asp or Glu
  VARIANT (3)..(3): Xaa is Asp or Glu
  VARIANT (8)..(8): Xaa is Gln, His, Arg, Lys, Tyr, Ile, Leu, or Trp
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XVXHIVPXSXXXDDSXXNKVLTXXXXN

SEQ ID NO: 28 - protein, 27 aa, Artificial Sequence
  HNH-like domain
  VARIANT (2)..(2): Xaa is Ile or Val
  VARIANT (6)..(6): Xaa is Ile or Val
  VARIANT (9)..(9): Xaa is Ala or Ser
  VARIANT (11)..(11): Xaa is Ile or Leu
  VARIANT (12)..(12): Xaa is Lys or Thr
  VARIANT (14)..(14): Xaa is Asp or Asn
  VARIANT (19)..(19): Xaa is Arg, Lys, or Leu
  VARIANT (22)..(22): Xaa is Thr or Val
  VARIANT (23)..(23): Xaa is Ser or Arg
  VARIANT (25)..(25): Xaa is Lys, Asp, or Ala
  VARIANT (26)..(26): Xaa is Glu, Lys, Gly, or Asn
DXDHIXPQXFXXDXSIDNXVLXXSXXN

SEQ ID NO: 29 - RNA, 116 nt, Artificial Sequence
  gRNA
  misc_feature (1)..(20): a, c, u, g, unknown or other
  misc_feature (1)..(20): targeting region
  misc_feature (21)..(42): first complementarity domain
  misc_feature (43)..(46): linking domain
  misc_feature (47)..(70): second complementarity domain
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 116 nt, Artificial Sequence
  gRNA
  misc_feature (1)..(20): a, c, u, g, unknown or other
  misc_feature (1)..(20): targeting region
  misc_feature (21)..(42): first complementarity domain
  misc_feature (43)..(46): linking domain
  misc_feature (47)..(70): second complementarity domain
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 31 - RNA, 96 nt, Artificial Sequence
  gRNA
  misc_feature (1)..(20): a, c, u, g, unknown or other
  misc_feature (1)..(20): targeting domain
  misc_feature (21)..(32): first complementarity domain
  misc_feature (33)..(36): linking domain
  misc_feature (37)..(50): second complementarity domain
  misc_feature (51)..(62): proximal domain
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 47 nt, Artificial Sequence
  gRNA proximal and tail domains derived from S. pyogenes
aaggcuaguccguuaucaacuugaaaaaguggcaccgagucggugcu

SEQ ID NO: 33 - RNA, 49 nt, Artificial Sequence
  gRNA proximal and tail domains
aaggcuaguccguuaucaacuugaaaaaguggcaccgagucgguggugc

SEQ ID NO: 34 - RNA, 51 nt, Artificial Sequence
  gRNA proximal and tail domains
aaggcuaguccguuaucaacuugaaaaaguggcaccgagucggugcggauc

SEQ ID NO: 35 - RNA, 31 nt, Artificial Sequence
  gRNA proximal and tail domains
aaggcuaguccguuaucaacuugaaaaagug

SEQ ID NO: 36 - RNA, 18 nt, Artificial Sequence
  gRNA proximal and tail domains
aaggcuaguccguuauca

SEQ ID NO: 37 - RNA, 12 nt, Artificial Sequence
  gRNA proximal and tail domains
aaggcuaguccg

SEQ ID NO: 38 - RNA, 102 nt, Artificial Sequence
  Unimolecular gRNA derived from S. aureus
  misc_feature (1)..(20): n is a, c, g, or u
  misc_feature (1)..(20): Targeting domain
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 39 - RNA, 42 nt, Artificial
  Modular gRNA derived from S. pyogenes
  misc_feature (1)..(20): a, c, u, g, unknown or other
  misc_feature (1)..(20): Targeting domain
  misc_feature (21)..(42): First complementarity domain
nnnnnnnnnnnnnnnnnnnnguuuuagagcuaugcuguuuug

SEQ ID NO: 40 - RNA, 85 nt, Artificial Sequence
  Modular gRNA derived from S. pyogenes
  misc_feature (1)..(9): 5' extension domain
  misc_feature (10)..(33): Second complementarity domain
  misc_feature (34)..(45): Proximal domain
  misc_feature (46)..(85): Tail domain
ggaaccauucaaaacagcauagcaaguuaaaauaaggcuaguccguuaucaacuugaaaaaguggcaccgagucggugcuuuuuu

SEQ ID NO: 41 - RNA, 62 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguuuuagagcuagaaauagcaaguuaaaauaaggcuaguccg

SEQ ID NO: 42 - RNA, 102 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
  misc_feature (63)..(102): Tail domain
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 43 - RNA, 75 nt, Artificial Sequence
  Unimolecular gRNA derived from S. pyogenes
  misc_feature (1)..(20): Targeting domain
  misc_feature (1)..(20): a, c, u, g, unknown or other
  misc_feature (21)..(36): First complementarity domain
  misc_feature (37)..(40): Linking domain
  misc_feature (41)..(58): Second complementarity domain
  misc_feature (59)..(70): Proximal domain
  misc_feature (71)..(75): Tail domain
nnnnnnnnnnnnnnnnnnnnguuuuagagcuaugcugaaaagcauagcaaguuaaaauaaggcuaguccguuauc

SEQ ID NO: 44 - RNA, 87 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (43)..(46): Linking domain
  misc_feature (57)..(70): Second complementarity domain
  misc_feature (71)..(82): Proximal domain
  misc_feature (83)..(87): Tail domain
nnnnnnnnnnnnnnnnnnnnguuuuagagcuaugcuguuuuggaaacaaaacagcauagcaaguuaaaauaaggcuaguccguuauc

SEQ ID NO: 45 - RNA, 42 nt, Artificial Sequence
  Modular gRNA derived from S. thermophilus
  misc_feature (1)..(20): a, c, u, g, unknown or other
  misc_feature (1)..(20): Targeting domain
  misc_feature (21)..(42): First complementarity domain
nnnnnnnnnnnnnnnnnnnnguuuuagagcuguguuguuucg

SEQ ID NO: 46 - RNA, 78 nt, Artificial Sequence
  Modular gRNA derived from S. thermophilus
  misc_feature (1)..(3): 5' extension domain
  misc_feature (4)..(27): Second complementarity domain
  misc_feature (28)..(40): Proximal domain
  misc_feature (41)..(78): Tail domain
gggcgaaacaacacagcgaguuaaaauaaggcuuaguccguacucaacuugaaaagguggcaccgauucgguguuuuu

SEQ ID NO: 47 - RNA, 85 nt, Artificial Sequence
  Modular gRNA derived from S. pyogenes
gaaccauucaaaacagcauagcaaguuaaaauaaggcuaguccguuaucaacuugaaaaaguggcaccgagucggugcuuuuuuu

SEQ ID NO: 48 - RNA, 96 nt, Artificial Sequence
  gRNA from S. pyogenes
  misc_feature (1)..(20): n is a, c, g, or u
  misc_feature (1)..(20): Targeting domain
nnnnnnnnnnnnnnnnnnnnguuuuagagcuagaaauagcaaguuaaaauaaggcuaguccguuaucaacuugaaaaaguggcaccgagucggugc

SEQ ID NO: 49 - RNA, 96 nt, Artificial Sequence
  gRNA
  misc_feature (1)..(20): n is a, c, g, or u
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguauuagagcuagaaauagcaaguuaauauaaggcuaguccguuaucaacuugaaaaaguggcaccgagucggugc

SEQ ID NO: 50 - RNA, 104 nt, Artificial Sequence
  gRNA
  misc_feature (1)..(20): n is a, c, g, or u
  misc_feature (1)..(20): Targeting domain
  misc_feature (21)..(36): First complementarity domain
  misc_feature (37)..(40): Linking domain
  misc_feature (41)..(58): Second complementarity domain
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 51 - RNA, 106 nt, Artificial Sequence
  gRNA
  misc_feature (1)..(20): n is a, c, g, or u
  misc_feature (1)..(20): Targeting domain
  misc_feature (21)..(37): First complementarity domain
  misc_feature (38)..(41): Linking domain
  misc_feature (42)..(60): Second complementarity domain
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 52 - protein, 12 aa, Peptoniphilus duerdenii
DIGTASVGWAVT

SEQ ID NO: 53 - protein, 12 aa, Treponema denticola
DVGTGSVGWAVT

SEQ ID NO: 54 - protein, 12 aa, S. mutans
DIGTNSVGWAVV

SEQ ID NO: 55 - protein, 12 aa, S. pyogenes
DIGTNSVGWAVI

SEQ ID NO: 56 - protein, 12 aa, L. innocua
DIGTNSVGWAVL

SEQ ID NO: 57 - protein, 12 aa, Flavobacterium branchiophilum FL-15
DLGTNSIGWAVV

SEQ ID NO: 58 - protein, 11 aa, Pedobacter glucosidilyticus
DLGTNSIGWAI

SEQ ID NO: 59 - protein, 12 aa, Bacteroides fragilis, NCTC 9343
DLGTNSIGWALV

SEQ ID NO: 60 - protein, 12 aa, Fusobacterium nucleatum
DIGTNSVGWCVT

SEQ ID NO: 61 - protein, 12 aa, Acidaminococcus sp. D21
DIGTNSVGYAVT

SEQ ID NO: 62 - protein, 12 aa, Coprococcus catus GD-7
DMGTGSLGWAVT

SEQ ID NO: 63 - protein, 12 aa, Oenococcus kitaharae DSM 17330
DIGTSSVGWAAI

SEQ ID NO: 64 - protein, 12 aa, Catenibacterium mitsuokai DSM 15897
DLGTGSVGWAVV

SEQ ID NO: 65 - protein, 12 aa, Mycoplasma gallisepticum str. F
DLGVGSVGWAIV

SEQ ID NO: 66 - protein, 12 aa, Mycoplasma ovipneumoniae SC01
DLGIASIGWAII

SEQ ID NO: 67 - protein, 12 aa, Mycoplasma canis PG 14
DLGIASVGWAIV

SEQ ID NO: 68 - protein, 12 aa, Mycoplasma synoviae 53
DLGVASVGWSIV

SEQ ID NO: 69 - protein, 12 aa, Eubacterium rectale
DIGIASVGWAIL

SEQ ID NO: 70 - protein, 12 aa, Enterococcus faecalis TX0012
DLGISSVGWSVI

SEQ ID NO: 71 - protein, 12 aa, Ilyobacter polytropus DSM 2926
DIGIASVGWSVI

SEQ ID NO: 72 - protein, 12 aa, Ruminococcus albus 8
DVGIGSIGWAVI

SEQ ID NO: 73 - protein, 12 aa, Elusimicrobium minutum Pei191
DLGVGSIGFAIV

SEQ ID NO: 74 - protein, 12 aa, Akkermansia muciniphila
DIGYASIGWAVI

SEQ ID NO: 75 - protein, 12 aa, Prevotella ruminicola
DTGTNSLGWAIV

SEQ ID NO: 76 - protein, 12 aa, Cand. Puniceispirillum marinum
DLGTNSIGWCLL

SEQ ID NO: 77 - protein, 12 aa, Rhodospirillum rubrum
DIGTDSLGWAVF

SEQ ID NO: 78 - protein, 12 aa, Lactobacillus rhamnosus GG
DIGSNSIGFAVV

SEQ ID NO: 79 - protein, 12 aa, Sphaerochaeta globus str. Buddy
DLGVGSIGVAVA

SEQ ID NO: 80 - protein, 12 aa, Rhodopseudomonas palustris
DLGIASCGWGVV

SEQ ID NO: 81 - protein, 12 aa, Mycoplasma mobile 163K
DLGIASVGWCLT

SEQ ID NO: 82 - protein, 12 aa, Streptococcus thermophilus LMD-9
DIGIGSVGVGIL

SEQ ID NO: 83 - protein, 12 aa, Staphylococcus lugdunensis M23590
DIGITSVGYGLI

SEQ ID NO: 84 - protein, 12 aa, Eubacterium dolichum DSM 3991
DIGITSVGFGII

SEQ ID NO: 85 - protein, 12 aa, Lactobacillus coryniformis KCTC 3535
DVGITSTGYAVL

SEQ ID NO: 86 - protein, 12 aa, Nitratifractor salsuginis DSM 16511
DLGITSFGYAIL

SEQ ID NO: 87 - protein, 12 aa, Bifidobacterium bifidum S17
DIGNASVGWSAF

SEQ ID NO: 88 - protein, 12 aa, Lactobacillus gasseri
DVGTNSCGWVAM

SEQ ID NO: 89 - protein, 12 aa, Acidothermus cellulolyticus 11B
DVGERSIGLAAV

SEQ ID NO: 90 - protein, 12 aa, Bifidobacterium longum DJO10A
DVGLNSVGLAAV

SEQ ID NO: 91 - protein, 12 aa, Bifidobacterium dentium
DVGLMSVGLAAI

SEQ ID NO: 92 - protein, 12 aa, Corynebacterium diphtheriae
DVGTFSVGLAAI

SEQ ID NO: 93 - protein, 12 aa, Staphylococcus pseudintermedius ED99
DIGTGSVGYACM

SEQ ID NO: 94 - protein, 12 aa, Capnocytophaga ochracea
DLGTTSIGFAHI

SEQ ID NO: 95 - protein, 12 aa, Prevotella denticola
DLGTNSIGSSVR

SEQ ID NO: 96 - protein, 12 aa, Ralstonia solanacearum
DIGTNSIGWAVI

SEQ ID NO: 97 - protein, 12 aa, Pasteurella multocida str. Pm70
DLGIASVGWAVV

SEQ ID NO: 98 - protein, 12 aa, Comamonas granuli
DIGIASVGWAVL

SEQ ID NO: 99 - protein, 12 aa, Helicobacter mustelae 12198
DIGIASIGWAVI

SEQ ID NO: 100 - protein, 12 aa, Agathobacter rectalis
DIGIASVGWAII

SEQ ID NO: 101 - protein, 12 aa, Clostridium cellulolyticum H10
DVGIASVGWAVI

SEQ ID NO: 102 - protein, 11 aa, Methylophilus sp. OH31
DIGIASVGWAL

SEQ ID NO: 103 - protein, 12 aa, Neisseria meningitidis
DIGIASVGWAMV

SEQ ID NO: 104 - protein, 12 aa, Clostridium perfringens
DIGITSVGWAVI

SEQ ID NO: 105 - protein, 12 aa, Wolinella succinogenes DSM 1740
DLGISSLGWAIV

SEQ ID NO: 106 - protein, 12 aa, Azospirillum sp. B510
DLGTNSIGWGLL

SEQ ID NO: 107 - protein, 12 aa, Verminephrobacter eiseniae
DLGSTSLGWAIF

SEQ ID NO: 108 - protein, 12 aa, Campylobacter jejuni, NCTC 11168
DIGISSIGWAFS

SEQ ID NO: 109 - protein, 12 aa, Parvibaculum lavamentivorans DS-1
DIGTTSIGFSVI

SEQ ID NO: 110 - protein, 12 aa, Dinoroseobacter shibae DFL 12
DIGTSSIGWWLY

SEQ ID NO: 111 - protein, 12 aa, Nitrobacter hamburgensis X14
DLGSNSLGWFVT

SEQ ID NO: 112 - protein, 12 aa, Bradyrhizobium sp. BTAi1
DLGANSLGWFVV

SEQ ID NO: 113 - protein, 15 aa, Bacillus cereus
DIGLRIGITSCGWSI

SEQ ID NO: 114 - protein, 12 aa, Sutterella wadsworthensis
DMGAKYTGVFYA

SEQ ID NO: 115 - protein, 12 aa, Wolinella succinogenes DSM 1740
DLGGKNTGFFSF

SEQ ID NO: 116 - protein, 12 aa, Francisella tularensis
DLGVKNTGVFSA

SEQ ID NO: 117 - protein, 12 aa, Gamma proteobacterium HTCC5015
DLGAKFTGVALY

SEQ ID NO: 118 - protein, 12 aa, Legionella pneumophila str. Paris
DLGGKFTGVCLS

SEQ ID NO: 119 - protein, 12 aa, Parasutterella excrementihominis
DLGGTYTGTFIT

SEQ ID NO: 120 - protein, 12 aa, S. thermophilus
DIGTNSVGWAVT

SEQ ID NO: 121 - protein, 12 aa, Eubacterium yurii
DVGTNSVGWAVT

SEQ ID NO: 122 - protein, 12 aa, Butyrivibrio hungatei
DMGTNSVGWAVT

SEQ ID NO: 123 - protein, 12 aa, Solobacterium moorei F0204
DVGTSSVGWAVT

SEQ ID NO: 124 - protein, 27 aa, Treponema denticola
DIDHIYPQSKIKDDSISNRVLVCSSCN

SEQ ID NO: 125 - protein, 27 aa, Coprococcus catus GD-7
DIDHIYPQSKTMDDSLNNRVLVKKNYN

SEQ ID NO: 126 - protein, 27 aa, Peptoniphilus duerdenii
DQDHIYPKSKIYDDSLENRVLVKKNLN

SEQ ID NO: 127 - protein, 27 aa, Catenibacterium mitsuokai DSM 15897
QIDHIVPQSLVKDDSFDNRVLVVPSEN

SEQ ID NO: 128 - protein, 27 aa, S. mutans
DIDHIIPQAFIKDNSIDNRVLTSSKEN

SEQ ID NO: 129 - protein, 27 aa, S. thermophilus
DIDHIIPQAFLKDNSIDNKVLVSSASN

SEQ ID NO: 130 - protein, 27 aa, Oenococcus kitaharae DSM 17330
DIDHIIPQAYTKDNSLDNRVLVSNITN

SEQ ID NO: 131 - protein, 27 aa, L. inocua
DIDHIVPQSFITDNSIDNLVLTSSAGN

SEQ ID NO: 132 - protein, 27 aa, S. pyogenes
DVDHIVPQSFLKDDSIDNKVLTRSDKN

SEQ ID NO: 133 - protein, 27 aa, Acidaminococcus sp. D21
NIDHIYPQSMVKDDSLDNKVLVQSEIN

SEQ ID NO: 134 - protein, 27 aa, Lactobacillus rhamnosus GG
DIDHILPQSLIKDDSLDNRVLVNATIN

SEQ ID NO: 135 - protein, 27 aa, Lactobacillus gasseri
DIDHILPQSFIKDDSLENRVLVKKAVN

SEQ ID NO: 136 - protein, 27 aa, Staphylococcus pseudintermedius ED99
EVDHIFPRSFIKDDSIDNKVLVIKKMN

SEQ ID NO: 137 - protein, 27 aa, Olsenella uli
EVDHIIPRSYIKDDSFENKVLVYREEN

SEQ ID NO: 138 - protein, 27 aa, Bifidobacterium bifidum S17
DIDHIIPQAVTQNDSIDNRVLVARAEN

SEQ ID NO: 139 - protein, 27 aa, Mycoplasma gallisepticum str. F
EIDHIIPYSISFDDSSSNKLLVLAESN

SEQ ID NO: 140 - protein, 27 aa, Mycoplasma canis PG 14
EIDHIIPYSLCFDDSSANKVLVHKQSN

SEQ ID NO: 141 - protein, 27 aa, Ilyobacter polytropus DSM 2926
DIDHIIPYSRSMDDSYSNKVLVLSGEN

SEQ ID NO: 142 - protein, 27 aa, Uncultured Termite group 1 bacterium
DIDHIIPYSKSMDDSFNNKVLCLAEEN

SEQ ID NO: 143 - protein, 27 aa, Campylobacter jejuni
EIDHIYPYSRSFDDSYMNKVLVFTKQN

SEQ ID NO: 144 - protein, 27 aa, Clostridium cellulolyticum H10
QIDHIYPYSRSMDDSYMNKVLVLTDEN

SEQ ID NO: 145 - protein, 27 aa, Clostridium perfringens
EIDHIIPFSRSFDDSLSNKILVLGSEN

SEQ ID NO: 146 - protein, 27 aa, N. meningitides
EIDHALPFSRTWDDSFNNKVLVLGSEN

SEQ ID NO: 147 - protein, 27 aa, Pasteurella multocida str. Pm70
EIDHALPFSRTWDDSFNNKVLVLASEN

SEQ ID NO: 148 - protein, 27 aa, Enterococcus faecalis TX0012
EIDHIIPISISLDDSINNKVLVLSKAN

SEQ ID NO: 149 - protein, 27 aa, Eubacterium dolichum DSM 3991
EVDHIIPISISLDDSITNKVLVTHREN

SEQ ID NO: 150 - protein, 27 aa, Acidovorax ebreus
QVDHALPYSRSYDDSKNNKVLVLTHEN

SEQ ID NO: 151 - protein, 27 aa, Streptococcus thermophilus LMD-9
EVDHILPLSITFDDSLANKVLVYATAN

SEQ ID NO: 152 - protein, 27 aa, Eubacterium rectale
EIDHIIPRSISFDDARSNKVLVYRSEN

SEQ ID NO: 153 - protein, 27 aa, Staphylococcus lugdunensis M23590
EVDHIIPRSVSFDNSYHNKVLVKQSEN

SEQ ID NO: 154 - protein, 27 aa, Roseburia intestinalis
DIDHILPYSITFDDSFRNKVLVTSQEN

SEQ ID NO: 155 - protein, 27 aa, Wolinella succinogenes DSM 1740
EIDHILPRSRSADDSFANKVLCLARAN

SEQ ID NO: 156 - protein, 27 aa, Cand. Puniceispirillum marinum
EIEHLLPFSLTLDDSMANKTVCFRQAN

SEQ ID NO: 157 - protein, 27 aa, Azospirillum sp. B510
DIDHILPFSVSLDDSAANKVVCLREAN

SEQ ID NO: 158 - protein, 27 aa, Bradyrhizobium sp. BTAi1
DIDHLIPFSISWDDSAANKVVCMRYAN

SEQ ID NO: 159 - protein, 27 aa, Nitrobacter hamburgensis X14
DIDHILPVAMTLDDSPANKIICMRYAN

SEQ ID NO: 160 - protein, 27 aa, Dinoroseobacter shibae
DVDHILPYSRTLDDSFPNRTLCLREAN

SEQ ID NO: 161 - protein, 27 aa, Verminephrobacter eiseniae
EIEHILPFSRTLDDSLNNRTVAMRRAN

SEQ ID NO: 162 - protein, 27 aa, Lactobacillus coryniformis KCTC 3535
EVDHIIPYSISWDDSYTNKVLTSAKCN

SEQ ID NO: 163 - protein, 27 aa, Rhodopseudomonas palustris
QVDHILPWSRFGDDSYLNKTLCTARSN

SEQ ID NO: 164 - protein, 27 aa, Ralstonia syzygii R24
QVDHILPFSKTLDDSFANKVLAQHDAN

SEQ ID NO: 165 - protein, 27 aa, Helicobacter mustelae 12198
QIDHAFPLSRSLDDSQSNKVLCLTSSN

SEQ ID NO: 166 - protein, 27 aa, Mycoplasma mobile 163K
DIDHIVPRSISFDDSFSNLVIVNKLDN

SEQ ID NO: 167 - protein, 27 aa, Mycoplasma ovipneumoniae SC01
EIEHIIPYSMSYDNSQANKILTEKAEN

SEQ ID NO: 168 - protein, 27 aa, Mycoplasma synoviae 53
EIDHVIPYSKSADDSWFNKLLVKKSTN

SEQ ID NO: 169 - protein, 27 aa, Aminomonas paucivorans DSM 12260
EMDHILPYSRSLDNGWHNRVLVHGKDN

SEQ ID NO: 170 - protein, 27 aa, Ruminococcus albus 8
EVDHIVPYSLILDNTINNKALVYAEEN

SEQ ID NO: 171 - protein, 27 aa, Fibrobacter succinogenes
EIEHVIPQSLYFDDSFSNKVICEAEVN

SEQ ID NO: 172 - protein, 27 aa, Bacteroides fragilis, NCTC 9343
DIEHIIPQARLFDDSFSNKTLEARSVN

SEQ ID NO: 173 - protein, 27 aa, Capnocytophaga sputigena
EIEHIVPKARVFDDSFSNKTLTFHRIN

SEQ ID NO: 174 - protein, 28 aa, Finegoldia magna
DKDHIIPQSMKKDDSIINNLVLVNKNAN

SEQ ID NO: 175 - protein, 27 aa, Parvibaculum lavamentivorans DS-1
EVEHIWPRSRSFDNSPRNKTLCRKDVN

SEQ ID NO: 176 - protein, 27 aa, Bacillus cereus
IVNHIIPYNRSFDDTYHNRVLTLTETK

SEQ ID NO: 177 - protein, 27 aa, Prevotella micans
DMEHTIPKSISFDNSDQNLTLCESYYN

SEQ ID NO: 178 - protein, 27 aa, Prevotella ruminicola
DIEHTIPRSAGGDSTKMNLTLCSSRFN

SEQ ID NO: 179 - protein, 27 aa, Flavobacterium columnare
DIEHTIPRSISQDNSQMNKTLCSLKFN

SEQ ID NO: 180 - protein, 27 aa, Rhodospirillum rubrum
DIDHVIPLARGGRDSLDNMVLCQSDAN

SEQ ID NO: 181 - protein, 27 aa, Elusimicrobium minutum Pei191
DIEHLFPIAESEDNGRNNLVISHSACN

SEQ ID NO: 182 - protein, 27 aa, Sphaerochaeta globus str. Buddy
DVDHIFPRDDTADNSYGNKVVAHRQCN

SEQ ID NO: 183 - protein, 27 aa, Nitratifractor salsuginis DSM 16511
DIEHIVPQSLGGLSTDYNTIVTLKSVN

SEQ ID NO: 184 - protein, 27 aa, Acidothermus cellulolyticus 11B
ELDHIVPRTDGGSNRHENLAITCGACN

SEQ ID NO: 185 - protein, 28 aa, Bifidobacterium longum DJO10A
EMDHIVPRKGVGSTNTRTNFAAVCAECN

SEQ ID NO: 186 - protein, 28 aa, Bifidobacterium dentium
EMDHIVPRKGVGSTNTRVNLAAACAACN

SEQ ID NO: 187 - protein, 28 aa, Corynebacterium diphtheria
EMDHIVPRAGQGSTNTRENLVAVCHRCN

SEQ ID NO: 188 - protein, 33 aa, Sutterella wadsworthensis
EIDHILPRSLIKDARGIVFNAEPNLIYASSRGN

SEQ ID NO: 189 - protein, 33 aa, Gamma proteobacterium HTCC5015
EIDHIIPRSLTGRTKKTVFNSEANLIYCSSKGN

SEQ ID NO: 190 - protein, 33 aa, Parasutterella excrementihominis
EIDHIIPRSLTLKKSESIYNSEVNLIFVSAQGN

SEQ ID NO: 191 - protein, 33 aa, Legionella pneumophila str. Paris
EIDHIYPRSLSKKHFGVIFNSEVNLIYCSSQGN

SEQ ID NO: 192 - protein, 33 aa, Wolinella succinogenes DSM 1740
EIDHILPRSHTLKIYGTVFNPEGNLIYVHQKCN

SEQ ID NO: 193 - protein, 30 aa, Francisella tularensis
ELDHIIPRSHKKYGTLNDEANLICVTRGDN

SEQ ID NO: 194 - protein, 27 aa, Akkermansia muciniphila
ELEHIVPHSFRQSNALSSLVLTWPGVN

SEQ ID NO: 195 - protein, 27 aa, Solobacterium moorei F0204
DIDHIYPRSKIKDDSITNRVLVEKDIN

SEQ ID NO: 196 - protein, 28 aa, Veillonella atypica ACS-134-V-Col7a
YDIDHIYPRSLTKDDSFDNLVLCERTAN

SEQ ID NO: 197 - protein, 28 aa, Fusobacterium nucleatum
DIDHIYPRSKVIKDDSFDNLVLVLKNEN

SEQ ID NO: 198 - protein, 27 aa, Filifactor alocis
DRDHIYPQSKIKDDSIDNLVLVNKTYN

SEQ ID NO: 199 - DNA, 5 bp, Streptococcus thermophilus
  misc_feature (1)..(1): n is a, c, g, or t
  misc_feature (4)..(4): n is a, c, g, or t
nggng

SEQ ID NO: 200 - DNA, 7 bp, Streptococcus thermophilus
  misc_feature (1)..(2): n is a, c, g, or t
  misc_feature (7)..(7): a or t
nnagaaw

SEQ ID NO: 201 - DNA, 4 bp, Streptococcus mutans
  misc_feature (1)..(1): n is a, c, g, or t
  misc_feature (4)..(4): a or g
naar

SEQ ID NO: 202 - DNA, 5 bp, Staphylococcus aureus
  misc_feature (1)..(2): n is a, c, g, or t
  misc_feature (4)..(4): a or g
  misc_feature (5)..(5): a or g
nngrr

SEQ ID NO: 203 - DNA, 6 bp, Staphylococcus aureus
  misc_feature (1)..(2): n is a, c, g, or t
  misc_feature (4)..(4): a or g
  misc_feature (5)..(5): a or g
  misc_feature (6)..(6): n is a, c, g, or t
nngrrn

SEQ ID NO: 204 - DNA, 6 bp, Staphylococcus aureus
  misc_feature (1)..(2): n is a, c, g, or t
  misc_feature (4)..(4): a or g
  misc_feature (5)..(5): a or g
nngrrt

SEQ ID NO: 205 - DNA, 6 bp, Staphylococcus aureus
  misc_feature (1)..(2): n is a, c, g, or t
  misc_feature (4)..(4): a or g
  misc_feature (5)..(5): a or g
  misc_feature (6)..(6): a, g, or c
nngrrv

SEQ ID NO: 206-250 - skipped (45 entries)

SEQ ID NO: 251 - DNA, 1257 bp, Homo sapiens
  CDS (1)..(1257): Corresponds to NTs 9362-10008, 11459-11729, 12989-13136, and 13960-14151 of SEQ ID NO:2231
atgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataa

SEQ ID NO: 252 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 253 - RNA, 20 nt, Artificial Sequence
  Targeting Domain
ggguauggccucuaaaaaca

SEQ ID NO: 254 - RNA, 20 nt, Artificial Sequence
  Targeting Domain
gaccucgggggggauagaca

SEQ ID NO: 255 - RNA, 20 nt, Artificial Sequence
  Targeting Domain
ggagcaaggccuaugugaca

SEQ ID NO: 256 - RNA, 20 nt, Artificial Sequence
  Targeting Domain
ggucagcacagccuuaugca

SEQ ID NO: 257 - RNA, 20 nt, Artificial Sequence
  Targeting Domain
gcacagccuuaugcacggcc

SEQ ID NO: 258 - RNA, 20 nt, Artificial Sequence
  Targeting Domain
gccuuaugcacggccuggag

SEQ ID NO: 259 - RNA, 20 nt, Artificial Sequence
  Targeting Domain
ggccucgagcaaggcucacg

SEQ ID NO: 260 - RNA, 20 nt, Artificial Sequence
  Targeting Domain
guuuguugaacuugaccucg

SEQ ID NO: 261 - RNA, 20 nt, Artificial Sequence
  Targeting Domain
gcaaggccuaugugacaggg

SEQ ID NO: 262 - RNA, 20 nt, Artificial Sequence
  Targeting Domain
gagcgagaggcaguuauuuu

SEQ ID NO: 263 - RNA, 20 nt, Artificial Sequence
  Targeting Domain
cugaucccaggccucgagca

SEQ ID NO: 264 - RNA, 20 nt, Artificial Sequence
  Targeting Domain
auaggccuugcuccuccuca

SEQ ID NO: 265 - RNA, 20 nt, Artificial Sequence
  Targeting Domain
agccuuaugcacggccugga

SEQ ID NO: 266 - RNA, 20 nt, Artificial Sequence
  Targeting Domain
uccccuccaggccgugcaua

SEQ ID NO: 267 - RNA, 20 nt, Artificial Sequence
  Targeting Domain
agaagcagagacacguugua

SEQ ID NO: 268 - RNA, 20 nt, Artificial Sequence
  Targeting Domain
aggagcaaggccuaugugac

SEQ ID NO: 269 - RNA, 20 nt, Artificial Sequence
  Targeting Domain
cacguuguaaggcugauccc

SEQ ID NO: 270 - RNA, 20 nt, Artificial Sequence
  Targeting Domain
acccaugucuaucccccccg

SEQ ID NO: 271 - RNA, 20 nt, Artificial Sequence
  Targeting Domain
uuuguugaacuugaccucgg

SEQ ID NO: 272 - RNA, 20 nt, Artificial Sequence
  Targeting Domain
uuguugaacuugaccucggg

SEQ ID NO: 273 - RNA, 20 nt, Artificial Sequence
  Targeting Domain
uguugaacuugaccucgggg

SEQ ID NO: 274 - RNA, 20 nt, Artificial Sequence
  Targeting Domain
cagccuuaugcacggccugg

SEQ ID NO: 275 - RNA, 20 nt, Artificial Sequence
  Targeting Domain
accucgggggggauagacau

SEQ ID NO: 276 - RNA, 17 nt, Artificial Sequence
  Targeting Domain
gcaaggccuaugugaca

SEQ ID NO: 277 - RNA, 17 nt, Artificial Sequence
  Targeting Domain
gaggaugugcagggcca

SEQ ID NO: 278 - RNA, 17 nt, Artificial Sequence
  Targeting Domain
gagggagaggaugugca

SEQ ID NO: 279 - RNA, 17 nt, Artificial Sequence
  Targeting Domain
ggccuugcuccuccuca

SEQ ID NO: 280 - RNA, 17 nt, Artificial Sequence
  Targeting Domain
ggccuaugugacaggga

SEQ ID NO: 281 - RNA, 17 nt, Artificial Sequence
  Targeting Domain
gccagggauggagggga

SEQ ID NO: 282 - RNA, 17 nt, Artificial Sequence
  Targeting Domain
ggggauagacaugggua

SEQ ID NO: 283 - RNA, 17 nt, Artificial Sequence
  Targeting Domain
gaagcgcucacuccccc

SEQ ID NO: 284 - RNA, 17 nt, Artificial Sequence
  Targeting Domain
guuguaaggcugauccc

SEQ ID NO: 285 - RNA, 17 nt, Artificial Sequence
  Targeting Domain
gagccuugcucgaggcc

SEQ ID NO: 286 - RNA, 17 nt, Artificial Sequence
  Targeting Domain
ggggagugagcgcuucc

SEQ ID NO: 287 - RNA, 17 nt, Artificial Sequence
  Targeting Domain
ggagggagaggaugugc

SEQ ID NO: 288 - RNA, 17 nt, Artificial Sequence
  Targeting Domain
gggccagggccguccag

SEQ ID NO: 289 - RNA, 17 nt, Artificial Sequence
  Targeting Domain
ggccagggccguccagg

SEQ ID NO: 290 - RNA, 17 nt, Artificial Sequence
  Targeting Domain
guugaacuugaccucgg

SEQ ID NO: 291 - RNA, 17 nt, Artificial Sequence
  Targeting Domain
gggagugagcgcuuccu

SEQ ID NO: 292 - RNA, 17 nt, Artificial Sequence
  Targeting Domain
ggcaguuauuuuugggu

SEQ ID NO: 293 - RNA, 17 nt, Artificial Sequence
  Targeting Domain
gcuccuccucaaggcuu

SEQ ID NO: 294 - RNA, 17 nt, Artificial Sequence
  Targeting Domain
gagaggcaguuauuuuu

SEQ ID NO: 295 - RNA, 20 nt, Artificial Sequence
  Targeting Domain
gugcugaccaucgacaagaa

SEQ ID NO: 296 - RNA, 20 nt, Artificial Sequence
  Targeting Domain
ggagaggaugugcagggcca

SEQ ID NO: 297 - RNA, 20 nt, Artificial Sequence
  Targeting Domain
gggggggauagacaugggua

SEQ ID NO: 298 - RNA, 20 nt, Artificial Sequence
  Targeting Domain
ggcucacguggacaccuccc

SEQ ID NO: 299 - RNA, 20 nt, Artificial Sequence
  Targeting Domain
gggagaggaugugcagggcc

SEQ ID NO: 300 - RNA, 20 nt, Artificial Sequence
  Targeting Domain
gugcagggccagggccgucc

SEQ ID NO: 301 - RNA, 20 nt, Artificial Sequence
  Targeting Domain
gguuuguugaacuugaccuc

SEQ ID NO: 302 - RNA, 20 nt, Artificial Sequence
  Targeting Domain
gcagggccagggccguccag

SEQ ID NO: 303 - RNA, 20 nt, Artificial Sequence
  Targeting Domain
gggagggguugaggagcgag

SEQ ID NO: 304 - RNA, 20 nt, Artificial Sequence
  Targeting Domain
guccacgugagccuugcucg

SEQ ID NO: 305 - RNA, 20 nt, Artificial Sequence
  Targeting Domain
gggagugagcgcuuccuggg

SEQ ID NO: 306 - RNA, 20 nt, Artificial Sequence
  Targeting Domain
gagaggcaguuauuuuuggg

SEQ ID NO: 307 - RNA, 20 nt, Artificial Sequence
  Targeting Domain
gaaagggacugaagcugcug

SEQ ID NO: 308 - RNA, 20 nt, Artificial Sequence
  Targeting Domain
gggauggaggggagggguug

SEQ ID NO: 309 - RNA, 20 nt, Artificial Sequence
  Targeting Domain
ggguuuguugaacuugaccu

SEQ ID NO: 310 - RNA, 20 nt, Artificial Sequence
  Targeting Domain
gugagccuugcucgaggccu

SEQ ID NO: 311 - RNA, 17 nt, Artificial Sequence
  Targeting Domain
aucauuaagaagacaaa

SEQ ID NO: 312 - RNA, 17 nt, Artificial Sequence
  Targeting Domain
ugaccaucgacaagaaa

SEQ ID NO: 313 - RNA, 17 nt, Artificial Sequence
  Targeting Domain
aaucauuaagaagacaa

SEQ ID NO: 314 - RNA, 17 nt, Artificial Sequence
  Targeting Domain
cugaccaucgacaagaa

SEQ ID NO: 315 - RNA, 17 nt, Artificial Sequence
  Targeting Domain
uauggccucuaaaaaca

SEQ ID NO: 316 - RNA, 17 nt, Artificial Sequence
  Targeting Domain
cucgggggggauagaca

SEQ ID NO: 317 - RNA, 17 nt, Artificial Sequence
  Targeting Domain
agggccagggccgucca

SEQ ID NO: 318 - RNA, 17 nt, Artificial Sequence
  Targeting Domain
aucccaggccucgagca

SEQ ID NO: 319 - RNA, 17 nt, Artificial Sequence
  Targeting Domain
agccuugaggaggagca

SEQ ID NO: 320 - RNA, 17 nt, Artificial Sequence
  Targeting Domain
cagcacagccuuaugca

SEQ ID NO: 321 - RNA, 17 nt, Artificial Sequence
  Targeting Domain
caagucuccccucuuca

SEQ ID NO: 322 - RNA, 17 nt, Artificial Sequence
  Targeting Domain
cacuuuucccaugaaga

SEQ ID NO: 323 - RNA, 17 nt, Artificial Sequence
  Targeting Domain
agucccuuucuugucga

SEQ ID NO: 324 - RNA, 17 nt, Artificial Sequence
  Targeting Domain
cgcucacucccccugga

SEQ ID NO: 325 - RNA, 17 nt, Artificial Sequence
  Targeting Domain
cuuaugcacggccugga

SEQ ID NO: 326 - RNA, 17 nt, Artificial Sequence
  Targeting Domain
ccuccaggccgugcaua

SEQ ID NO: 327 - RNA, 17 nt, Artificial Sequence
  Targeting Domain
agcagagacacguugua

SEQ ID NO: 328 - RNA, 17 nt, Artificial Sequence
  Targeting Domain
agcaaggccuaugugac

SEQ ID NO: 329 - RNA, 17 nt, Artificial Sequence
  Targeting Domain
cucccccuggacggccc

SEQ ID NO: 330 - RNA, 17 nt, Artificial Sequence
  Targeting Domain
ccccuccccuccauccc

SEQ ID NO: 331 - RNA, 17 nt, Artificial Sequence
  Targeting Domain
ucacguggacaccuccc

SEQ ID NO: 332 - RNA, 17 nt, Artificial Sequence
  Targeting Domain
cagccuuaugcacggcc

SEQ ID NO: 333 - RNA, 17 nt, Artificial Sequence
  Targeting Domain
agaggaugugcagggcc

SEQ ID NO: 334 - RNA, 17 nt, Artificial Sequence
  Targeting Domain
cugcuucucuccccucc

SEQ ID NO: 335 - RNA, 17 nt, Artificial Sequence
  Targeting Domain
cagggccagggccgucc

SEQ ID NO: 336 - RNA, 17 nt, Artificial Sequence
  Targeting Domain
aaagggacugaagcugc

SEQ ID NO: 337 - RNA, 17 nt, Artificial Sequence
  Targeting Domain
uuguugaacuugaccuc

SEQ ID NO: 338 - RNA, 17 nt, Artificial Sequence
  Targeting Domain
ccucuucaugggaaaag

SEQ ID NO: 339 - RNA, 17 nt, Artificial Sequence
  Targeting Domain
ccacuuuucccaugaag

SEQ ID NO: 340 - RNA, 17 nt, Artificial Sequence
  Targeting Domain
acuuuucccaugaagag

SEQ ID NO: 341 - RNA, 17 nt, Artificial Sequence
  Targeting Domain
agggguugaggagcgag

SEQ ID NO: 342 - RNA, 17 nt, Artificial Sequence
  Targeting Domain
augugacagggagggag

SEQ ID NO: 343 - RNA, 17 nt, Artificial Sequence
  Targeting Domain
ccagggauggaggggag

SEQ ID NO: 344 - RNA, 17 nt, Artificial Sequence
  Targeting Domain
uuaugcacggccuggag

SEQ ID NO: 345 - RNA, 17 nt, Artificial Sequence
  Targeting Domain
uggggccauguuuuuag

SEQ ID NO: 346 - RNA, 17 nt, Artificial Sequence
  Targeting Domain
cucgagcaaggcucacg

SEQ ID NO: 347 - RNA, 17 nt, Artificial Sequence
  Targeting Domain
caugucuaucccccccg

SEQ ID NO: 348 - RNA, 17 nt, Artificial Sequence
  Targeting Domain
uguugaacuugaccucg

SEQ ID NO: 349 - RNA, 17 nt, Artificial Sequence
  Targeting Domain
cacgugagccuugcucg

SEQ ID NO: 350 - RNA, 17 nt, Artificial Sequence
  Targeting Domain
cagccaaagccuugagg

SEQ ID NO: 351 - RNA, 17 nt, Artificial Sequence
  Targeting Domain
aggccuaugugacaggg

SEQ ID NO: 352 - RNA, 17 nt, Artificial Sequence
  Targeting Domain
uugaacuugaccucggg

SEQ ID NO: 353 - RNA, 17 nt, Artificial Sequence
  Targeting Domain
ugaacuugaccucgggg

SEQ ID NO: 354 - RNA, 17 nt, Artificial Sequence
  Targeting Domain
agugagcgcuuccuggg

SEQ ID NO: 355 - RNA, 17 nt, Artificial Sequence
  Targeting Domain
aggcaguuauuuuuggg

SEQ ID NO: 356 - RNA, 17 nt, Artificial Sequence
  Targeting Domain
ccuuaugcacggccugg

SEQ ID NO: 357 - RNA, 17 nt, Artificial Sequence
  Targeting Domain
agggacugaagcugcug

SEQ ID NO: 358 - RNA, 17 nt, Artificial Sequence
  Targeting Domain
caucagccaaagccuug

SEQ ID NO: 359 - RNA, 17 nt, Artificial Sequence
  Targeting Domain
auggaggggagggguug

SEQ ID NO: 360 - RNA, 17 nt, Artificial Sequence
  Targeting Domain
cucccucccugucacau

SEQ ID NO: 361 - RNA, 17 nt, Artificial Sequence
  Targeting Domain
ucgggggggauagacau

SEQ ID NO: 362 - RNA, 17 nt, Artificial Sequence
  Targeting Domain
aagucuccccucuucau

SEQ ID NO: 363 - RNA, 17 nt, Artificial Sequence
  Targeting Domain
caugaagaggggagacu

SEQ ID NO: 364 - RNA, 17 nt, Artificial Sequence
  Targeting Domain
uuuguugaacuugaccu

SEQ ID NO: 365 - RNA, 17 nt, Artificial Sequence
  Targeting Domain
agccuugcucgaggccu

SEQ ID NO: 366 - RNA, 17 nt, Artificial Sequence
  Targeting Domain
aagggacugaagcugcu

SEQ ID NO: 367 - RNA, 17 nt, Artificial Sequence
  Targeting Domain
cgagaggcaguuauuuu

SEQ ID NO: 368 - RNA, 20 nt, Artificial Sequence
  Targeting Domain
ucaaucauuaagaagacaaa

SEQ ID NO: 369 - RNA, 20 nt, Artificial Sequence
  Targeting Domain
ugcugaccaucgacaagaaa

SEQ ID NO: 370 - RNA, 20 nt, Artificial Sequence
  Targeting Domain
uucaaucauuaagaagacaa

SEQ ID NO: 371 - RNA, 20 nt, Artificial Sequence
  Targeting Domain
ugcagggccagggccgucca

SEQ ID NO: 372 - RNA, 20 nt, Artificial Sequence
  Targeting Domain
caaagccuugaggaggagca

SEQ ID NO: 373 - RNA, 20 nt, Artificial Sequence
  Targeting Domain
agggagggagaggaugugca

SEQ ID NO: 374 - RNA, 20 nt, Artificial Sequence
  Targeting Domain
uaccaagucuccccucuuca

SEQ ID NO: 375 - RNA, 20 nt, Artificial Sequence
  Targeting Domain
caccacuuuucccaugaaga

SEQ ID NO: 376 - RNA, 20 nt, Artificial Sequence
  Targeting Domain
uucagucccuuucuugucga

SEQ ID NO: 377 - RNA, 20 nt, Artificial Sequence
  Targeting Domain
caaggccuaugugacaggga

SEQ ID NO: 378 - RNA, 20 nt, Artificial Sequence
  Targeting Domain
aagcgcucacucccccugga

SEQ ID NO: 379 - RNA, 20 nt, Artificial Sequence
  Targeting Domain
caggaagcgcucacuccccc

SEQ ID NO: 380 - RNA, 20 nt, Artificial Sequence
  Targeting Domain
ucacucccccuggacggccc

SEQ ID NO: 381 - RNA, 20 nt, Artificial Sequence
  Targeting Domain
caaccccuccccuccauccc

SEQ ID NO: 382 - RNA, 20 nt, Artificial Sequence
  Targeting Domain
cgugagccuugcucgaggcc

SEQ ID NO: 383 - RNA, 20 nt, Artificial Sequence
  Targeting Domain
ucucugcuucucuccccucc

SEQ ID NO: 384 - RNA, 20 nt, Artificial Sequence
  Targeting Domain
cagggggagugagcgcuucc

SEQ ID NO: 385 - RNA, 20 nt, Artificial Sequence
  Targeting Domain
aagaaagggacugaagcugc

SEQ ID NO: 386 - RNA, 20 nt, Artificial Sequence
  Targeting Domain
cagggagggagaggaugugc

SEQ ID NO: 387 - RNA, 20 nt, Artificial Sequence
  Targeting Domain
uccccucuucaugggaaaag

SEQ ID NO: 388 - RNA, 20 nt, Artificial Sequence
  Targeting Domain
ucaccacuuuucccaugaag

SEQ ID NO: 389 - RNA, 20 nt, Artificial Sequence
  Targeting Domain
accacuuuucccaugaagag

SEQ ID NO: 390 - RNA, 20 nt, Artificial Sequence
  Targeting Domain
ccuaugugacagggagggag

SEQ ID NO: 391 - RNA, 20 nt, Artificial Sequence
  Targeting Domain
ugcuggggccauguuuuuag

SEQ ID NO: 392 - RNA, 20 nt, Artificial Sequence
  Targeting Domain
cagggccagggccguccagg

SEQ ID NO: 393 - RNA, 20 nt, Artificial Sequence
  Targeting Domain
caucagccaaagccuugagg

SEQ ID NO: 394 - RNA, 20 nt, Artificial Sequence
  Targeting Domain
ccucucccucccugucacau

SEQ ID NO: 395 - RNA, 20 nt, Artificial Sequence
  Targeting Domain
accaagucuccccucuucau

SEQ ID NO: 396 - RNA, 20 nt, Artificial Sequence
  Targeting Domain
ucccaugaagaggggagacu

SEQ ID NO: 397 - RNA, 20 nt, Artificial Sequence
  Targeting Domain
agggggagugagcgcuuccu

SEQ ID NO: 398 - RNA, 20 nt, Artificial Sequence
  Targeting Domain
agaaagggacugaagcugcu

SEQ ID NO: 399 - RNA, 20 nt, Artificial Sequence
  Targeting Domain
agaggcaguuauuuuugggu

SEQ ID NO: 400 - RNA, 20 nt, Artificial Sequence
  Targeting Domain
cuugcuccuccucaaggcuu

SEQ ID NO: 401 - RNA, 20 nt, Artificial Sequence
  Targeting Domain
agcgagaggcaguuauuuuu

SEQ ID NO: 402 - RNA, 19 nt, Artificial Sequence
  Targeting Domain
gaccucgggggggauagac

SEQ ID NO: 403 - RNA, 18 nt, Artificial Sequence
  Targeting Domain
guugaacuugaccucggg

SEQ ID NO: 404 - RNA, 22 nt, Artificial Sequence
  Targeting Domain
guuuguugaacuugaccucggg

SEQ ID NO: 405 - RNA, 23 nt, Artificial Sequence
  Targeting Domain
gguuuguugaacuugaccucggg

SEQ ID NO: 406 - RNA, 24 nt, Artificial Sequence
  Targeting Domain
ggguuuguugaacuugaccucggg

SEQ ID NO: 407 - RNA, 22 nt, Artificial Sequence
  Targeting Domain
gcgagaggcaguuauuuuuggg

SEQ ID NO: 408 - RNA, 24 nt, Artificial Sequence
  Targeting Domain
gagcgagaggcaguuauuuuuggg

SEQ ID NO: 409 - RNA, 22 nt, Artificial Sequence
  Targeting Domain
gaggagcgagaggcaguuauuu

SEQ ID NO: 410 - RNA, 21 nt, Artificial Sequence
  Targeting Domain
ggccuaugugacagggaggga

SEQ ID NO: 411 - RNA, 21 nt, Artificial Sequence
  Targeting Domain
gcagggccagggccguccagg

SEQ ID NO: 412 - RNA, 23 nt, Artificial Sequence
  Targeting Domain
gugcagggccagggccguccagg

SEQ ID NO: 413 - RNA, 18 nt, Artificial Sequence
  Targeting Domain
accucgggggggauagac

SEQ ID NO: 414 - RNA, 20 nt, Artificial Sequence
  Targeting Domain
ugaccucgggggggauagac

SEQ ID NO: 415 - RNA, 21 nt, Artificial Sequence
  Targeting Domain
uugaccucgggggggauagac

SEQ ID NO: 416 - RNA, 22 nt, Artificial Sequence
  Targeting Domain
cuugaccucgggggggauagac

SEQ ID NO: 417 - RNA, 23 nt, Artificial Sequence
  Targeting Domain
acuugaccucgggggggauagac

SEQ ID NO: 418 - RNA, 24 nt, Artificial Sequence
  Targeting Domain
aacuugaccucgggggggauagac

SEQ ID NO: 419 - RNA, 19 nt, Artificial Sequence
  Targeting Domain
uguugaacuugaccucggg

SEQ ID NO: 420 - RNA, 21 nt, Artificial Sequence
  Targeting Domain
uuuguugaacuugaccucggg

SEQ ID NO: 421 - RNA, 21 nt, Artificial Sequence
  Targeting Domain
cgagaggcaguuauuuuuggg

SEQ ID NO: 422 - RNA, 23 nt, Artificial Sequence
  Targeting Domain
agcgagaggcaguuauuuuuggg

SEQ ID NO: 423 - RNA, 21 nt, Artificial Sequence
  Targeting Domain
aggagcgagaggcaguuauuu

SEQ ID NO: 424 - RNA, 23 nt, Artificial Sequence
  Targeting Domain
ugaggagcgagaggcaguuauuu

SEQ ID NO: 425 - RNA, 24 nt, Artificial Sequence
  Targeting Domain
uugaggagcgagaggcaguuauuu

SEQ ID NO: 426 - RNA, 22 nt, Artificial Sequence
  Targeting Domain
aggccuaugugacagggaggga

SEQ ID NO: 427 - RNA, 23 nt, Artificial Sequence
  Targeting Domain
aaggccuaugugacagggaggga

SEQ ID NO: 428 - RNA, 24 nt, Artificial Sequence
  Targeting Domain
caaggccuaugugacagggaggga

SEQ ID NO: 429 - RNA, 21 nt, Artificial Sequence
  Targeting Domain
acgugagccuugcucgaggcc

SEQ ID NO: 430 - RNA, 22 nt, Artificial Sequence
  Targeting Domain
cacgugagccuugcucgaggcc

SEQ ID NO: 431 - RNA, 23 nt, Artificial Sequence
  Targeting Domain
ccacgugagccuugcucgaggcc

SEQ ID NO: 432 - RNA, 24 nt, Artificial Sequence
  Targeting Domain
uccacgugagccuugcucgaggcc

SEQ ID NO: 433 - RNA, 22 nt, Artificial Sequence
  Targeting Domain
ugcagggccagggccguccagg

SEQ ID NO: 434 - RNA, 24 nt, Artificial Sequence
  Targeting Domain
ugugcagggccagggccguccagg

SEQ ID NO: 435 - RNA, 21 nt, Artificial Sequence
  Targeting Domain
ccccucuucaugggaaaagug

SEQ ID NO: 436 - RNA, 22 nt, Artificial Sequence
  Targeting Domain
uccccucuucaugggaaaagug

SEQ ID NO: 437 - RNA, 23 nt, Artificial Sequence
  Targeting Domain
cuccccucuucaugggaaaagug

SEQ ID NO: 438 - RNA, 24 nt, Artificial Sequence
  Targeting Domain
ucuccccucuucaugggaaaagug

SEQ ID NO: 439 - RNA, 20 nt, Artificial Sequence
  Targeting Domain
guucaaucauuaagaagaca

SEQ ID NO: 440 - RNA, 18 nt, Artificial Sequence
  Targeting Domain
gaggcaguuauuuuuggg

SEQ ID NO: 441 - RNA, 19 nt, Artificial Sequence
  Targeting Domain
gagcgagaggcaguuauuu

SEQ ID NO: 442 - RNA, 20 nt, Artificial Sequence
  Targeting Domain
ggagcgagaggcaguuauuu

SEQ ID NO: 443 - RNA, 20 nt, Artificial Sequence
  Targeting Domain
gccuaugugacagggaggga

SEQ ID NO: 444 - RNA, 19 nt, Artificial Sequence
  Targeting Domain
gugagccuugcucgaggcc

SEQ ID NO: 445 - RNA, 18 nt, Artificial Sequence
  Targeting Domain
gggccagggccguccagg

SEQ ID NO: 446 - RNA, 18 nt, Artificial Sequence
  Targeting Domain
ucaaucauuaagaagaca

SEQ ID NO: 447 - RNA, 19 nt, Artificial Sequence
  Targeting Domain
uucaaucauuaagaagaca

SEQ ID NO: 448 - RNA, 21 nt, Artificial Sequence
  Targeting Domain
uguucaaucauuaagaagaca

SEQ ID NO: 449 - RNA, 22 nt, Artificial Sequence
  Targeting Domain
uuguucaaucauuaagaagaca

SEQ ID NO: 450 - RNA, 23 nt, Artificial Sequence
  Targeting Domain
uuuguucaaucauuaagaagaca

SEQ ID NO: 451 - RNA, 24 nt, Artificial Sequence
  Targeting Domain
uuuuguucaaucauuaagaagaca

SEQ ID NO: 452 - RNA, 19 nt, Artificial Sequence
  Targeting Domain
agaggcaguuauuuuuggg

SEQ ID NO: 453 - RNA, 18 nt, Artificial Sequence
  Targeting Domain
agcgagaggcaguuauuu

SEQ ID NO: 454 - RNA, 18 nt, Artificial Sequence
  Targeting Domain
cuaugugacagggaggga

SEQ ID NO: 455 - RNA, 19 nt, Artificial Sequence
  Targeting Domain
ccuaugugacagggaggga

SEQ ID NO: 456 - RNA, 18 nt, Artificial Sequence
  Targeting Domain
ugagccuugcucgaggcc

SEQ ID NO: 457 - RNA, 19 nt, Artificial Sequence
  Targeting Domain
agggccagggccguccagg

SEQ ID NO: 458 - RNA, 18 nt, Artificial Sequence
  Targeting Domain
cucuucaugggaaaagug

SEQ ID NO: 459 - RNA, 19 nt, Artificial Sequence
  Targeting Domain
ccucuucaugggaaaagug

SEQ ID NO: 460 - RNA, 20 nt, Artificial Sequence
  Targeting Domain
cccucuucaugggaaaagug

SEQ ID NO: 461 - RNA, 18 nt, Artificial Sequence
  Targeting Domain
caccacuuuucccaugaa

SEQ ID NO: 462 - RNA, 19 nt, Artificial Sequence
  Targeting Domain
ucaccacuuuucccaugaa

SEQ ID NO: 463 - RNA, 20 nt, Artificial Sequence
  Targeting Domain
uucaccacuuuucccaugaa

SEQ ID NO: 464 - RNA, 21 nt, Artificial Sequence
  Targeting Domain
auucaccacuuuucccaugaa

SEQ ID NO: 465 - RNA, 22 nt, Artificial Sequence
  Targeting Domain
gauucaccacuuuucccaugaa

SEQ ID NO: 466 - RNA, 23 nt, Artificial Sequence
  Targeting Domain
ggauucaccacuuuucccaugaa

SEQ ID NO: 467 - RNA, 24 nt, Artificial Sequence
  Targeting Domain
gggauucaccacuuuucccaugaa

SEQ ID NO: 468 - RNA, 18 nt, Artificial Sequence
  Targeting Domain
ccacuuuucccaugaaga

SEQ ID NO: 469 - RNA, 19 nt, Artificial Sequence
  Targeting Domain
accacuuuucccaugaaga

SEQ ID NO: 470 - RNA, 21 nt, Artificial Sequence
  Targeting Domain
ucaccacuuuucccaugaaga

SEQ ID NO: 471 - RNA, 22 nt, Artificial Sequence
  Targeting Domain
uucaccacuuuucccaugaaga

SEQ ID NO: 472 - RNA, 23 nt, Artificial Sequence
  Targeting Domain
auucaccacuuuucccaugaaga

SEQ ID NO: 473 - RNA, 24 nt, Artificial Sequence
  Targeting Domain
gauucaccacuuuucccaugaaga

SEQ ID NO: 474 - RNA, 18 nt, Artificial Sequence
  Targeting Domain
gaggggagggguugagga

SEQ ID NO: 475 - RNA, 19 nt, Artificial Sequence
  Targeting Domain
ggaggggagggguugagga

SEQ ID NO: 476 - RNA, 20 nt, Artificial Sequence
  Targeting Domain
uggaggggagggguugagga

SEQ ID NO: 477 - RNA, 21 nt, Artificial Sequence
  Targeting Domain
auggaggggagggguugagga

SEQ ID NO: 478 - RNA, 22 nt, Artificial Sequence
  Targeting Domain
gauggaggggagggguugagga

SEQ ID NO: 479 - RNA, 23 nt, Artificial Sequence
  Targeting Domain
ggauggaggggagggguugagga

SEQ ID NO: 480 - RNA, 24 nt, Artificial Sequence
  Targeting Domain
gggauggaggggagggguugagga

SEQ ID NO: 481 - RNA, 18 nt, Artificial Sequence
  Targeting Domain
ugcacggccuggagggga

SEQ ID NO: 482 - RNA, 19 nt, Artificial Sequence
  Targeting Domain
augcacggccuggagggga

SEQ ID NO: 483 - RNA, 20 nt, Artificial Sequence
  Targeting Domain
uaugcacggccuggagggga

SEQ ID NO: 484 - RNA, 21 nt, Artificial Sequence
  Targeting Domain
uuaugcacggccuggagggga

SEQ ID NO: 485 - RNA, 22 nt, Artificial Sequence
  Targeting Domain
cuuaugcacggccuggagggga

SEQ ID NO: 486 - RNA, 23 nt, Artificial Sequence
  Targeting Domain
ccuuaugcacggccuggagggga

SEQ ID NO: 487 - RNA, 24 nt, Artificial Sequence
  Targeting Domain
gccuuaugcacggccuggagggga

SEQ ID NO: 488 - RNA, 18 nt, Artificial Sequence
  Targeting Domain
ccuuaugcacggccugga

SEQ ID NO: 489 - RNA, 19 nt, Artificial Sequence
  Targeting Domain
gccuuaugcacggccugga

SEQ ID NO: 490 - RNA, 21 nt, Artificial Sequence
  Targeting Domain
cagccuuaugcacggccugga

SEQ ID NO: 491 - RNA, 22 nt, Artificial Sequence
  Targeting Domain
acagccuuaugcacggccugga

SEQ ID NO: 492 - RNA, 23 nt, Artificial Sequence
  Targeting Domain
cacagccuuaugcacggccugga

SEQ ID NO: 493 - RNA, 24 nt, Artificial Sequence
  Targeting Domain
gcacagccuuaugcacggccugga

SEQ ID NO: 494 - RNA, 18 nt, Artificial Sequence
  Targeting Domain
gccucgagcaaggcucac

SEQ ID NO: 495 - RNA, 19 nt, Artificial Sequence
  Targeting Domain
ggccucgagcaaggcucac

SEQ ID NO: 496 - RNA, 20 nt, Artificial Sequence
  Targeting Domain
aggccucgagcaaggcucac

SEQ ID NO: 497 - RNA, 21 nt, Artificial Sequence
  Targeting Domain
caggccucgagcaaggcucac

SEQ ID NO: 498 - RNA, 22 nt, Artificial Sequence
  Targeting Domain
ccaggccucgagcaaggcucac

SEQ ID NO: 499 - RNA, 23 nt, Artificial Sequence
  Targeting Domain
cccaggccucgagcaaggcucac

SEQ ID NO: 500 - RNA, 24 nt, Artificial Sequence
  Targeting Domain
ucccaggccucgagcaaggcucac

SEQ ID NO: 501 - RNA, 18 nt, Artificial Sequence
  Targeting Domain
gguuuguugaacuugacc

SEQ ID NO: 502 - RNA, 19 nt, Artificial Sequence
  Targeting Domain
ggguuuguugaacuugacc

SEQ ID NO: 503 - RNA, 20 nt, Artificial Sequence
  Targeting Domain
aggguuuguugaacuugacc

SEQ ID NO: 504 - RNA, 21 nt, Artificial Sequence
  Targeting Domain
aaggguuuguugaacuugacc

SEQ ID NO: 505 - RNA, 22 nt, Artificial Sequence
  Targeting Domain
aaaggguuuguugaacuugacc

SEQ ID NO: 506 - RNA, 23 nt, Artificial Sequence
  Targeting Domain
caaaggguuuguugaacuugacc

SEQ ID NO: 507 - RNA, 24 nt, Artificial Sequence
  Targeting Domain
acaaaggguuuguugaacuugacc

SEQ ID NO: 508 - RNA, 18 nt, Artificial Sequence
  Targeting Domain
aggaagcgcucacucccc

SEQ ID NO: 509 - RNA, 19 nt, Artificial Sequence
  Targeting Domain
caggaagcgcucacucccc

SEQ ID NO: 510 - RNA, 20 nt, Artificial Sequence
  Targeting Domain
ccaggaagcgcucacucccc

SEQ ID NO: 511 - RNA, 21 nt, Artificial Sequence
  Targeting Domain
cccaggaagcgcucacucccc

SEQ ID NO: 512 - RNA, 22 nt, Artificial Sequence
  Targeting Domain
ucccaggaagcgcucacucccc

SEQ ID NO: 513 - RNA, 23 nt, Artificial Sequence
  Targeting Domain
cucccaggaagcgcucacucccc

SEQ ID NO: 514 - RNA, 24 nt, Artificial Sequence
  Targeting Domain
ccucccaggaagcgcucacucccc

SEQ ID NO: 515 - RNA, 18 nt, Artificial Sequence
  Targeting Domain
cucacguggacaccuccc

SEQ ID NO: 516 - RNA, 19 nt, Artificial Sequence
  Targeting Domain
gcucacguggacaccuccc

SEQ ID NO: 517 - RNA, 21 nt, Artificial Sequence
  Targeting Domain
aggcucacguggacaccuccc

SEQ ID NO: 518 - RNA, 22 nt, Artificial Sequence
  Targeting Domain
aaggcucacguggacaccuccc

SEQ ID NO: 519 - RNA, 23 nt, Artificial Sequence
  Targeting Domain
caaggcucacguggacaccuccc

SEQ ID NO: 520 - RNA, 24 nt, Artificial Sequence
  Targeting Domain
gcaaggcucacguggacaccuccc

SEQ ID NO: 521 - RNA, 18 nt, Artificial Sequence
  Targeting Domain
ggauucaccacuuuuccc

SEQ ID NO: 522 - RNA, 19 nt, Artificial Sequence
  Targeting Domain
gggauucaccacuuuuccc

SEQ ID NO: 523 - RNA, 20 nt, Artificial Sequence
  Targeting Domain
ugggauucaccacuuuuccc

SEQ ID NO: 524 - RNA, 21 nt, Artificial Sequence
  Targeting Domain
gugggauucaccacuuuuccc

SEQ ID NO: 525 - RNA, 22 nt, Artificial Sequence
  Targeting Domain
ggugggauucaccacuuuuccc

SEQ ID NO: 526 - RNA, 23 nt, Artificial Sequence
  Targeting Domain
gggugggauucaccacuuuuccc

SEQ ID NO: 527 - RNA, 24 nt, Artificial Sequence
  Targeting Domain
ugggugggauucaccacuuuuccc

SEQ ID NO: 528 - RNA, 18 nt, Artificial Sequence
  Targeting Domain
uaaggcugaucccaggcc

SEQ ID NO: 529 - RNA, 19 nt, Artificial Sequence
  Targeting Domain
guaaggcugaucccaggcc

SEQ ID NO: 530 - RNA, 20 nt, Artificial Sequence
  Targeting Domain
uguaaggcugaucccaggcc

SEQ ID NO: 531 - RNA, 21 nt, Artificial Sequence
  Targeting Domain
uuguaaggcugaucccaggcc

SEQ ID NO: 532 - RNA, 22 nt, Artificial Sequence
  Targeting Domain
guuguaaggcugaucccaggcc

SEQ ID NO: 533 - RNA, 23 nt, Artificial Sequence
  Targeting Domain
cguuguaaggcugaucccaggcc

SEQ ID NO: 534 - RNA, 24 nt, Artificial Sequence
  Targeting Domain
acguuguaaggcugaucccaggcc

SEQ ID NO: 535 - RNA, 18 nt, Artificial Sequence
  Targeting Domain
acagccuuaugcacggcc

SEQ ID NO: 536 - RNA, 19 nt, Artificial Sequence
  Targeting Domain
cacagccuuaugcacggcc

SEQ ID NO: 537 - RNA, 21 nt, Artificial Sequence
  Targeting Domain
agcacagccuuaugcacggcc

SEQ ID NO: 538 - RNA, 22 nt, Artificial Sequence
  Targeting Domain
cagcacagccuuaugcacggcc

SEQ ID NO: 539 - RNA, 23 nt, Artificial Sequence
  Targeting Domain
ucagcacagccuuaugcacggcc

SEQ ID NO: 540 - RNA, 24 nt, Artificial Sequence
  Targeting Domain
gucagcacagccuuaugcacggcc

SEQ ID NO: 541 - RNA, 18 nt, Artificial Sequence
  Targeting Domain
gcucacguggacaccucc

SEQ ID NO: 542 - RNA, 19 nt, Artificial Sequence
  Targeting Domain
ggcucacguggacaccucc

SEQ ID NO: 543 - RNA, 20 nt, Artificial Sequence
  Targeting Domain
aggcucacguggacaccucc

SEQ ID NO: 544 - RNA, 21 nt, Artificial Sequence
  Targeting Domain
aaggcucacguggacaccucc

SEQ ID NO: 545 - RNA, 22 nt, Artificial Sequence
  Targeting Domain
caaggcucacguggacaccucc

SEQ ID NO: 546 - RNA, 23 nt, Artificial Sequence
  Targeting Domain
gcaaggcucacguggacaccucc

SEQ ID NO: 547 - RNA, 24 nt, Artificial Sequence
  Targeting Domain
agcaaggcucacguggacaccucc

SEQ ID NO: 548 - RNA, 18 nt, Artificial Sequence
  Targeting Domain
ggggagggguugaggagc

SEQ ID NO: 549 - RNA, 19 nt, Artificial Sequence
  Targeting Domain
aggggagggguugaggagc

SEQ ID NO: 550 - RNA, 20 nt, Artificial Sequence
  Targeting Domain
gaggggagggguugaggagc

SEQ ID NO: 551 - RNA, 21 nt, Artificial Sequence
  Targeting Domain
ggaggggagggguugaggagc

SEQ ID NO: 552 - RNA, 22 nt, Artificial Sequence
  Targeting Domain
uggaggggagggguugaggagc

SEQ ID NO: 553 - RNA, 23 nt, Artificial Sequence
  Targeting Domain
auggaggggagggguugaggagc

SEQ ID NO: 554 - RNA, 24 nt, Artificial Sequence
  Targeting Domain
gauggaggggagggguugaggagc

SEQ ID NO: 555 - RNA, 18 nt, Artificial Sequence
  Targeting Domain
cacagccuuaugcacggc

SEQ ID NO: 556 - RNA, 19 nt, Artificial Sequence
  Targeting Domain
gcacagccuuaugcacggc

SEQ ID NO: 557 - RNA, 20 nt, Artificial Sequence
  Targeting Domain
agcacagccuuaugcacggc

SEQ ID NO: 558 - RNA, 21 nt, Artificial Sequence
  Targeting Domain
cagcacagccuuaugcacggc

SEQ ID NO: 559 - RNA, 22 nt, Artificial Sequence
  Targeting Domain
ucagcacagccuuaugcacggc

SEQ ID NO: 560 - RNA, 23 nt, Artificial Sequence
  Targeting Domain
gucagcacagccuuaugcacggc

SEQ ID NO: 561 - RNA, 24 nt, Artificial Sequence
  Targeting Domain
ggucagcacagccuuaugcacggc

SEQ ID NO: 562 - RNA, 18 nt, Artificial Sequence
  Targeting Domain
uuuguugaacuugaccuc

SEQ ID NO: 563 - RNA, 19 nt, Artificial Sequence
  Targeting Domain
guuuguugaacuugaccuc

SEQ ID NO: 564 - RNA, 21 nt, Artificial Sequence
  Targeting Domain
ggguuuguugaacuugaccuc

SEQ ID NO: 565 - RNA, 22 nt, Artificial Sequence
  Targeting Domain
aggguuuguugaacuugaccuc

SEQ ID NO: 566 - RNA, 23 nt, Artificial Sequence
  Targeting Domain
aaggguuuguugaacuugaccuc

SEQ ID NO: 567 - RNA, 24 nt, Artificial Sequence
  Targeting Domain
aaaggguuuguugaacuugaccuc

SEQ ID NO: 568 - RNA, 18 nt, Artificial Sequence
  Targeting Domain
gccuggaggggagagaag

SEQ ID NO: 569 - RNA, 19 nt, Artificial Sequence
  Targeting Domain
ggccuggaggggagagaag

SEQ ID NO: 570 - RNA, 20 nt, Artificial Sequence
  Targeting Domain
cggccuggaggggagagaag

SEQ ID NO: 571 - RNA, 21 nt, Artificial Sequence
  Targeting Domain
acggccuggaggggagagaag

SEQ ID NO: 572 - RNA, 22 nt, Artificial Sequence
  Targeting Domain
cacggccuggaggggagagaag

SEQ ID NO: 573 - RNA, 23 nt, Artificial Sequence
  Targeting Domain
gcacggccuggaggggagagaag

SEQ ID NO: 574 - RNA, 24 nt, Artificial Sequence
  Targeting Domain
ugcacggccuggaggggagagaag

SEQ ID NO: 575 - RNA, 18 nt, Artificial Sequence
  Targeting Domain
accacuuuucccaugaag

SEQ ID NO: 576 - RNA, 19 nt, Artificial Sequence
  Targeting Domain
caccacuuuucccaugaag

SEQ ID NO: 577 - RNA, 21 nt, Artificial Sequence
  Targeting Domain
uucaccacuuuucccaugaag

SEQ ID NO: 578 - RNA, 22 nt, Artificial Sequence
  Targeting Domain
auucaccacuuuucccaugaag

SEQ ID NO: 579 - RNA, 23 nt, Artificial Sequence
  Targeting Domain
gauucaccacuuuucccaugaag

SEQ ID NO: 580 - RNA, 24 nt, Artificial Sequence
  Targeting Domain
ggauucaccacuuuucccaugaag

SEQ ID NO: 581 - RNA, 18 nt, Artificial Sequence
  Targeting Domain
cacuuuucccaugaagag

SEQ ID NO: 582 - RNA, 19 nt, Artificial Sequence
  Targeting Domain
ccacuuuucccaugaagag

SEQ ID NO: 583 - RNA, 21 nt, Artificial Sequence
  Targeting Domain
caccacuuuucccaugaagag

SEQ ID NO: 584 - RNA, 22 nt, Artificial Sequence
  Targeting Domain
ucaccacuuuucccaugaagag

SEQ ID NO: 585 - RNA, 23 nt, Artificial Sequence
  Targeting Domain
uucaccacuuuucccaugaagag

SEQ ID NO: 586 - RNA, 24 nt, Artificial Sequence
  Targeting Domain
auucaccacuuuucccaugaagag

SEQ ID NO: 587 - RNA, 18 nt, Artificial Sequence
  Targeting Domain
cuuaugcacggccuggag

SEQ ID NO: 588 - RNA, 19 nt, Artificial Sequence
  Targeting Domain
ccuuaugcacggccuggag

SEQ ID NO: 589 - RNA, 21 nt, Artificial Sequence
  Targeting Domain
agccuuaugcacggccuggag

SEQ ID NO: 590 - RNA, 22 nt, Artificial Sequence
  Targeting Domain
cagccuuaugcacggccuggag

SEQ ID NO: 591 - RNA, 23 nt, Artificial Sequence
  Targeting Domain
acagccuuaugcacggccuggag

SEQ ID NO: 592 - RNA, 24 nt, Artificial Sequence
  Targeting Domain
cacagccuuaugcacggccuggag

SEQ ID NO: 593 - RNA, 18 nt, Artificial Sequence
  Targeting Domain
uuguugaacuugaccucg

SEQ ID NO: 594 - RNA, 19 nt, Artificial Sequence
  Targeting Domain
uuuguugaacuugaccucg

SEQ ID NO: 595 - RNA, 21 nt, Artificial Sequence
  Targeting Domain
gguuuguugaacuugaccucg

SEQ ID NO: 596 - RNA, 22 nt, Artificial Sequence
  Targeting Domain
ggguuuguugaacuugaccucg

SEQ ID NO: 597 - RNA, 23 nt, Artificial Sequence
  Targeting Domain
aggguuuguugaacuugaccucg

SEQ ID NO: 598 - RNA, 24 nt, Artificial Sequence
  Targeting Domain
aaggguuuguugaacuugaccucg

SEQ ID NO: 599 - RNA, 18 nt, Artificial Sequence
  Targeting Domain
uguugaacuugaccucgg

SEQ ID NO: 600 - RNA, 19 nt, Artificial Sequence
  Targeting Domain
uuguugaacuugaccucgg

SEQ ID NO: 601 - RNA, 21 nt, Artificial Sequence
  Targeting Domain
guuuguugaacuugaccucgg

SEQ ID NO: 602 - RNA, 22 nt, Artificial Sequence
  Targeting Domain
gguuuguugaacuugaccucgg

SEQ ID NO: 603 - RNA, 23 nt, Artificial Sequence
  Targeting Domain
ggguuuguugaacuugaccucgg

SEQ ID NO: 604 - RNA, 24 nt, Artificial Sequence
  Targeting Domain
aggguuuguugaacuugaccucgg

SEQ ID NO: 605 - RNA, 18 nt, Artificial Sequence
  Targeting Domain
uaugcacggccuggaggg

SEQ ID NO: 606 - RNA, 19 nt, Artificial Sequence
  Targeting Domain
uuaugcacggccuggaggg

SEQ ID NO: 607 - RNA, 20 nt, Artificial Sequence
  Targeting Domain
cuuaugcacggccuggaggg

SEQ ID NO: 608 - RNA, 21 nt, Artificial Sequence
  Targeting Domain
ccuuaugcacggccuggaggg

SEQ ID NO: 609 - RNA, 22 nt, Artificial Sequence
  Targeting Domain
gccuuaugcacggccuggaggg

SEQ ID NO: 610 - RNA, 23 nt, Artificial Sequence
  Targeting Domain
agccuuaugcacggccuggaggg

SEQ ID NO: 611 - RNA, 24 nt, Artificial Sequence
  Targeting Domain
cagccuuaugcacggccuggaggg

SEQ ID NO: 612 - RNA, 18 nt, Artificial Sequence
  Targeting Domain
agggauggaggggagggg

SEQ ID NO: 613 - RNA, 19 nt, Artificial Sequence
  Targeting Domain
cagggauggaggggagggg

SEQ ID NO: 614 - RNA, 20 nt, Artificial Sequence
  Targeting Domain
ccagggauggaggggagggg

SEQ ID NO: 615 - RNA, 18 nt, Artificial Sequence
  Targeting Domain
gccuuaugcacggccugg

SEQ ID NO: 616 - RNA, 19 nt, Artificial Sequence
  Targeting Domain
agccuuaugcacggccugg

SEQ ID NO: 617 - RNA, 21 nt, Artificial Sequence
  Targeting Domain
acagccuuaugcacggccugg

SEQ ID NO: 618 - RNA, 22 nt, Artificial Sequence
  Targeting Domain
cacagccuuaugcacggccugg

SEQ ID NO: 619 - RNA, 23 nt, Artificial Sequence
  Targeting Domain
gcacagccuuaugcacggccugg

SEQ ID NO: 620 - RNA, 24 nt, Artificial Sequence
  Targeting Domain
agcacagccuuaugcacggccugg

SEQ ID NO: 621 - RNA, 18 nt, Artificial Sequence
  Targeting Domain
agaggcaguuauuuuugg

SEQ ID NO: 622 - RNA, 19 nt, Artificial Sequence
  Targeting Domain
gagaggcaguuauuuuugg

SEQ ID NO: 623 - RNA, 20 nt, Artificial Sequence
  Targeting Domain
cgagaggcaguuauuuuugg

SEQ ID NO: 624 - RNA, 21 nt, Artificial Sequence
  Targeting Domain
gcgagaggcaguuauuuuugg

SEQ ID NO: 625 - RNA, 22 nt, Artificial Sequence
  Targeting Domain
agcgagaggcaguuauuuuugg

SEQ ID NO: 626 - RNA, 23 nt, Artificial Sequence
  Targeting Domain
gagcgagaggcaguuauuuuugg

SEQ ID NO: 627 - RNA, 24 nt, Artificial Sequence
  Targeting Domain
ggagcgagaggcaguuauuuuugg

SEQ ID NO: 628 - RNA, 18 nt, Artificial Sequence
  Targeting Domain
uucaccacuuuucccaug

SEQ ID NO: 629 - RNA, 19 nt, Artificial Sequence
  Targeting Domain
auucaccacuuuucccaug

SEQ ID NO: 630 - RNA, 20 nt, Artificial Sequence
  Targeting Domain
gauucaccacuuuucccaug

SEQ ID NO: 631 - RNA, 21 nt, Artificial Sequence
  Targeting Domain
ggauucaccacuuuucccaug

SEQ ID NO: 632 - RNA, 22 nt, Artificial Sequence
  Targeting Domain
gggauucaccacuuuucccaug

SEQ ID NO: 633 - RNA, 23 nt, Artificial Sequence
  Targeting Domain
ugggauucaccacuuuucccaug

SEQ ID NO: 634 - RNA, 24 nt, Artificial Sequence
  Targeting Domain
gugggauucaccacuuuucccaug

SEQ ID NO: 635 - RNA, 18 nt, Artificial Sequence
  Targeting Domain
agccuuaugcacggccug

SEQ ID NO: 636 - RNA, 19 nt, Artificial Sequence
  Targeting Domain
cagccuuaugcacggccug

SEQ ID NO: 637 - RNA, 20 nt, Artificial Sequence
  Targeting Domain
acagccuuaugcacggccug

SEQ ID NO: 638 - RNA, 21 nt, Artificial Sequence
  Targeting Domain
cacagccuuaugcacggccug

SEQ ID NO: 639 - RNA, 22 nt, Artificial Sequence
  Targeting Domain
gcacagccuuaugcacggccug

SEQ ID NO: 640 - RNA, 23 nt, Artificial Sequence
  Targeting Domain
agcacagccuuaugcacggccug

SEQ ID NO: 641 - RNA, 24 nt, Artificial Sequence
  Targeting Domain
cagcacagccuuaugcacggccug

SEQ ID NO: 642 - RNA, 18 nt, Artificial Sequence
  Targeting Domain
gauggaggggagggguug

SEQ ID NO: 643 - RNA, 19 nt, Artificial Sequence
  Targeting Domain
ggauggaggggagggguug

SEQ ID NO: 644 - RNA, 21 nt, Artificial Sequence
  Targeting Domain
agggauggaggggagggguug

SEQ ID NO: 645 - RNA, 22 nt, Artificial Sequence
  Targeting Domain
cagggauggaggggagggguug

SEQ ID NO: 646 - RNA, 23 nt, Artificial Sequence
  Targeting Domain
ccagggauggaggggagggguug

SEQ ID NO: 647 - RNA, 24 nt, Artificial Sequence
  Targeting Domain
gccagggauggaggggagggguug

SEQ ID NO: 648 - RNA, 18 nt, Artificial Sequence
  Targeting Domain
aagaagacaaaggguuug

SEQ ID NO: 649 - RNA, 19 nt, Artificial Sequence
  Targeting Domain
uaagaagacaaaggguuug

SEQ ID NO: 650 - RNA, 20 nt, Artificial Sequence
  Targeting Domain
uuaagaagacaaaggguuug

SEQ ID NO: 651 - RNA, 21 nt, Artificial Sequence
  Targeting Domain
auuaagaagacaaaggguuug

SEQ ID NO: 652 - RNA, 22 nt, Artificial Sequence
  Targeting Domain
cauuaagaagacaaaggguuug

SEQ ID NO: 653 - RNA, 23 nt, Artificial Sequence
  Targeting Domain
ucauuaagaagacaaaggguuug

SEQ ID NO: 654 - RNA, 24 nt, Artificial Sequence
  Targeting Domain
aucauuaagaagacaaaggguuug

SEQ ID NO: 655 - RNA, 18 nt, Artificial Sequence
  Targeting Domain
guuuguugaacuugaccu

SEQ ID NO: 656 - RNA, 19 nt, Artificial Sequence
  Targeting Domain
gguuuguugaacuugaccu

SEQ ID NO: 657 - RNA, 21 nt, Artificial Sequence
  Targeting Domain
aggguuuguugaacuugaccu

SEQ ID NO: 658 - RNA, 22 nt, Artificial Sequence
  Targeting Domain
aaggguuuguugaacuugaccu

SEQ ID NO: 659 - RNA, 23 nt, Artificial Sequence
  Targeting Domain
aaaggguuuguugaacuugaccu

SEQ ID NO: 660 - RNA, 24 nt, Artificial Sequence
  Targeting Domain
caaaggguuuguugaacuugaccu

SEQ ID NO: 661 - RNA, 18 nt, Artificial Sequence
  Targeting Domain
guauuuuguucaaucauu

SEQ ID NO: 662 - RNA, 19 nt, Artificial Sequence
  Targeting Domain
gguauuuuguucaaucauu

SEQ ID NO: 663 - RNA, 20 nt, Artificial Sequence
  Targeting Domain
ugguauuuuguucaaucauu

SEQ ID NO: 664 - RNA, 21 nt, Artificial Sequence
  Targeting Domain
uugguauuuuguucaaucauu

SEQ ID NO: 665 - RNA, 22 nt, Artificial Sequence
  Targeting Domain
cuugguauuuuguucaaucauu

SEQ ID NO: 666 - RNA, 23 nt, Artificial Sequence
  Targeting Domain
acuugguauuuuguucaaucauu

SEQ ID NO: 667 - RNA, 24 nt, Artificial Sequence
  Targeting Domain
gacuugguauuuuguucaaucauu

SEQ ID NO: 668 - RNA, 18 nt, Artificial Sequence
  Targeting Domain
ggauggaggggagggguu

SEQ ID NO: 669 - RNA, 19 nt, Artificial Sequence
  Targeting Domain
gggauggaggggagggguu

SEQ ID NO: 670 - RNA, 20 nt, Artificial Sequence
  Targeting Domain
agggauggaggggagggguu

SEQ ID NO: 671 - RNA, 18 nt, Artificial Sequence
  Targeting Domain
gcugaccaucgacaagaa

SEQ ID NO: 672 - RNA, 19 nt, Artificial Sequence
  Targeting Domain
ugcugaccaucgacaagaa

SEQ ID NO: 673 - RNA, 21 nt, Artificial Sequence
  Targeting Domain
ugugcugaccaucgacaagaa

SEQ ID NO: 674 - RNA, 22 nt, Artificial Sequence
  Targeting Domain
cugugcugaccaucgacaagaa

SEQ ID NO: 675 - RNA, 23 nt, Artificial Sequence
  Targeting Domain
gcugugcugaccaucgacaagaa

SEQ ID NO: 676 - RNA, 24 nt, Artificial Sequence
  Targeting Domain
ggcugugcugaccaucgacaagaa

SEQ ID NO: 677 - RNA, 18 nt, Artificial Sequence
  Targeting Domain
agcaaggccuaugugaca

SEQ ID NO: 678 - RNA, 19 nt, Artificial Sequence
  Targeting Domain
gagcaaggccuaugugaca

SEQ ID NO: 679 - RNA, 21 nt, Artificial Sequence
  Targeting Domain
aggagcaaggccuaugugaca

SEQ ID NO: 680 - RNA, 22 nt, Artificial Sequence
  Targeting Domain
gaggagcaaggccuaugugaca

SEQ ID NO: 681 - RNA, 23 nt, Artificial Sequence
  Targeting Domain
ggaggagcaaggccuaugugaca

SEQ ID NO: 682 - RNA, 24 nt, Artificial Sequence
  Targeting Domain
aggaggagcaaggccuaugugaca

SEQ ID NO: 683 - RNA, 18 nt, Artificial Sequence
  Targeting Domain
cagggccagggccgucca

SEQ ID NO: 684 - RNA, 19 nt, Artificial Sequence
  Targeting Domain
gcagggccagggccgucca

SEQ ID NO: 685 - RNA, 21 nt, Artificial Sequence
  Targeting Domain
gugcagggccagggccgucca

SEQ ID NO: 686 - RNA, 22 nt, Artificial Sequence
  Targeting Domain
ugugcagggccagggccgucca

SEQ ID NO: 687 - RNA, 23 nt, Artificial Sequence
  Targeting Domain
augugcagggccagggccgucca

SEQ ID NO: 688 - RNA, 24 nt, Artificial Sequence
  Targeting Domain
gaugugcagggccagggccgucca

SEQ ID NO: 689 - RNA, 18 nt, Artificial Sequence
  Targeting Domain
ccaagucuccccucuuca

SEQ ID NO: 690 - RNA, 19 nt, Artificial Sequence
  Targeting Domain
accaagucuccccucuuca

SEQ ID NO: 691 - RNA, 21 nt, Artificial Sequence
  Targeting Domain
auaccaagucuccccucuuca

SEQ ID NO: 692 - RNA, 22 nt, Artificial Sequence
  Targeting Domain
aauaccaagucuccccucuuca

SEQ ID NO: 693 - RNA, 23 nt, Artificial Sequence
  Targeting Domain
aaauaccaagucuccccucuuca

SEQ ID NO: 694 - RNA, 24 nt, Artificial Sequence
  Targeting Domain
aaaauaccaagucuccccucuuca

SEQ ID NO: 695 - RNA, 18 nt, Artificial Sequence
  Targeting Domain
ugcugaccaucgacaaga

SEQ ID NO: 696 - RNA, 19 nt, Artificial Sequence
  Targeting Domain
gugcugaccaucgacaaga

SEQ ID NO: 697 - RNA, 20 nt, Artificial Sequence
  Targeting Domain
ugugcugaccaucgacaaga

SEQ ID NO: 698 - RNA, 21 nt, Artificial Sequence
  Targeting Domain
cugugcugaccaucgacaaga

SEQ ID NO: 699 - RNA, 22 nt, Artificial Sequence
  Targeting Domain
gcugugcugaccaucgacaaga

SEQ ID NO: 700 - RNA, 23 nt, Artificial Sequence
  Targeting Domain
ggcugugcugaccaucgacaaga

SEQ ID NO: 701 - RNA, 24 nt, Artificial Sequence
  Targeting Domain
aggcugugcugaccaucgacaaga

SEQ ID NO: 702 - RNA, 18 nt, Artificial Sequence
  Targeting Domain
ccaucgacaagaaaggga

SEQ ID NO: 703 - RNA, 19 nt, Artificial Sequence
  Targeting Domain
accaucgacaagaaaggga

SEQ ID NO: 704 - RNA, 20 nt, Artificial Sequence
  Targeting Domain
gaccaucgacaagaaaggga

SEQ ID NO: 705 - RNA, 21 nt, Artificial Sequence
  Targeting Domain
ugaccaucgacaagaaaggga

SEQ ID NO: 706 - RNA, 22 nt, Artificial Sequence
  Targeting Domain
cugaccaucgacaagaaaggga

SEQ ID NO: 707 - RNA, 23 nt, Artificial Sequence
  Targeting Domain
gcugaccaucgacaagaaaggga

SEQ ID NO: 708 - RNA, 24 nt, Artificial Sequence
  Targeting Domain
ugcugaccaucgacaagaaaggga

SEQ ID NO: 709 - RNA, 18 nt, Artificial Sequence
  Targeting Domain
aggccuaugugacaggga

SEQ ID NO: 710 - RNA, 19 nt, Artificial Sequence
  Targeting Domain
aaggccuaugugacaggga

SEQ ID NO: 711 - RNA, 21 nt, Artificial Sequence
  Targeting Domain
gcaaggccuaugugacaggga

SEQ ID NO: 712 - RNA, 22 nt, Artificial Sequence
  Targeting Domain
agcaaggccuaugugacaggga

SEQ ID NO: 713 - RNA, 23 nt, Artificial Sequence
  Targeting Domain
gagcaaggccuaugugacaggga

SEQ ID NO: 714 - RNA, 24 nt, Artificial Sequence
  Targeting Domain
ggagcaaggccuaugugacaggga

SEQ ID NO: 715 - RNA, 18 nt, Artificial Sequence
  Targeting Domain
cagggccguccaggggga

SEQ ID NO: 716 - RNA, 19 nt, Artificial Sequence
  Targeting Domain
ccagggccguccaggggga

SEQ ID NO: 717 - RNA, 20 nt, Artificial Sequence
  Targeting Domain
gccagggccguccaggggga

SEQ ID NO: 718 - RNA, 21 nt, Artificial Sequence
  Targeting Domain
ggccagggccguccaggggga

SEQ ID NO: 719 - RNA, 22 nt, Artificial Sequence
  Targeting Domain
gggccagggccguccaggggga

SEQ ID NO: 720 - RNA, 23 nt, Artificial Sequence
  Targeting Domain
agggccagggccguccaggggga

SEQ ID NO: 721 - RNA, 24 nt, Artificial Sequence
  Targeting Domain
cagggccagggccguccaggggga

SEQ ID NO: 722 - RNA, 18 nt, Artificial Sequence
  Targeting Domain
ccuuugucuucuuaauga

SEQ ID NO: 723 - RNA, 19 nt, Artificial Sequence
  Targeting Domain
cccuuugucuucuuaauga

SEQ ID NO: 724 - RNA, 20 nt, Artificial Sequence
  Targeting Domain
acccuuugucuucuuaauga

SEQ ID NO: 725 - RNA, 21 nt, Artificial Sequence
  Targeting Domain
aacccuuugucuucuuaauga

SEQ ID NO: 726 - RNA, 22 nt, Artificial Sequence
  Targeting Domain
aaacccuuugucuucuuaauga

SEQ ID NO: 727 - RNA, 23 nt, Artificial Sequence
  Targeting Domain
caaacccuuugucuucuuaauga

SEQ ID NO: 728 - RNA, 24 nt, Artificial Sequence
  Targeting Domain
acaaacccuuugucuucuuaauga

SEQ ID NO: 729 - RNA, 18 nt, Artificial Sequence
  Targeting Domain
ggagcaaggccuauguga

SEQ ID NO: 730 - RNA, 19 nt, Artificial Sequence
  Targeting Domain
aggagcaaggccuauguga

SEQ ID NO: 731 - RNA, 20 nt, Artificial Sequence
  Targeting Domain
gaggagcaaggccuauguga

SEQ ID NO: 732 - RNA, 21 nt, Artificial Sequence
  Targeting Domain
ggaggagcaaggccuauguga

SEQ ID NO: 733 - RNA, 22 nt, Artificial Sequence
  Targeting Domain
aggaggagcaaggccuauguga

SEQ ID NO: 734 - RNA, 23 nt, Artificial Sequence
  Targeting Domain
gaggaggagcaaggccuauguga

SEQ ID NO: 735 - RNA, 24 nt, Artificial Sequence
  Targeting Domain
ugaggaggagcaaggccuauguga

SEQ ID NO: 736 - RNA, 18 nt, Artificial Sequence
  Targeting Domain
uuccugggagguguccac

SEQ ID NO: 737 - RNA, 19 nt, Artificial Sequence
  Targeting Domain
cuuccugggagguguccac

SEQ ID NO: 738 - RNA, 20 nt, Artificial Sequence
  Targeting Domain
gcuuccugggagguguccac

SEQ ID NO: 739 - RNA, 21 nt, Artificial Sequence
  Targeting Domain
cgcuuccugggagguguccac

SEQ ID NO: 740 - RNA, 22 nt, Artificial Sequence
  Targeting Domain
gcgcuuccugggagguguccac

SEQ ID NO: 741 - RNA, 23 nt, Artificial Sequence
  Targeting Domain
agcgcuuccugggagguguccac

SEQ ID NO: 742 - RNA, 24 nt, Artificial Sequence
  Targeting Domain
gagcgcuuccugggagguguccac

SEQ ID NO: 743 - RNA, 18 nt, Artificial Sequence
  Targeting Domain
gcugugcugaccaucgac

SEQ ID NO: 744 - RNA, 19 nt, Artificial Sequence
  Targeting Domain
ggcugugcugaccaucgac

SEQ ID NO: 745 - RNA, 20 nt, Artificial Sequence
  Targeting Domain
aggcugugcugaccaucgac

SEQ ID NO: 746 - RNA, 21 nt, Artificial Sequence
  Targeting Domain
aaggcugugcugaccaucgac

SEQ ID NO: 747 - RNA, 22 nt, Artificial Sequence
  Targeting Domain
uaaggcugugcugaccaucgac

SEQ ID NO: 748 - RNA, 23 nt, Artificial Sequence
  Targeting Domain
auaaggcugugcugaccaucgac

SEQ ID NO: 749 - RNA, 24 nt, Artificial Sequence
  Targeting Domain
cauaaggcugugcugaccaucgac

SEQ ID NO: 750 - RNA, 18 nt, Artificial Sequence
  Targeting Domain
gagcaaggccuaugugac

SEQ ID NO: 751 - RNA, 19 nt, Artificial Sequence
  Targeting Domain
ggagcaaggccuaugugac

SEQ ID NO: 752 - RNA, 21 nt, Artificial Sequence
  Targeting Domain
gaggagcaaggccuaugugac

SEQ ID NO: 753 - RNA, 22 nt, Artificial Sequence
  Targeting Domain
ggaggagcaaggccuaugugac

SEQ ID NO: 754 - RNA, 23 nt, Artificial Sequence
  Targeting Domain
aggaggagcaaggccuaugugac

SEQ ID NO: 755 - RNA, 24 nt, Artificial Sequence
  Targeting Domain
gaggaggagcaaggccuaugugac

SEQ ID NO: 756 - RNA, 18 nt, Artificial Sequence
  Targeting Domain
uacccaugucuauccccc

SEQ ID NO: 757 - RNA, 19 nt, Artificial Sequence
  Targeting Domain
auacccaugucuauccccc

SEQ ID NO: 758 - RNA, 20 nt, Artificial Sequence
  Targeting Domain
cauacccaugucuauccccc

SEQ ID NO: 759 - RNA, 21 nt, Artificial Sequence
  Targeting Domain
ccauacccaugucuauccccc

SEQ ID NO: 760 - RNA, 22 nt, Artificial Sequence
  Targeting Domain
gccauacccaugucuauccccc

SEQ ID NO: 761 - RNA, 23 nt, Artificial Sequence
  Targeting Domain
ggccauacccaugucuauccccc

SEQ ID NO: 762 - RNA, 24 nt, Artificial Sequence
  Targeting Domain
aggccauacccaugucuauccccc

SEQ ID NO: 763 - RNA, 18 nt, Artificial Sequence
  Targeting Domain
gcagggccagggccgucc

SEQ ID NO: 764 - RNA, 19 nt, Artificial Sequence
  Targeting Domain
ugcagggccagggccgucc

SEQ ID NO: 765 - RNA, 21 nt, Artificial Sequence
  Targeting Domain
ugugcagggccagggccgucc

SEQ ID NO: 766 - RNA, 22 nt, Artificial Sequence
  Targeting Domain
augugcagggccagggccgucc

SEQ ID NO: 767 - RNA, 23 nt, Artificial Sequence
  Targeting Domain
gaugugcagggccagggccgucc

SEQ ID NO: 768 - RNA, 24 nt, Artificial Sequence
  Targeting Domain
ggaugugcagggccagggccgucc

SEQ ID NO: 769 - RNA, 18 nt, Artificial Sequence
  Targeting Domain
gggggagugagcgcuucc

SEQ ID NO: 770 - RNA, 19 nt, Artificial Sequence
  Targeting Domain
agggggagugagcgcuucc

SEQ ID NO: 771 - RNA, 21 nt, Artificial Sequence
  Targeting Domain
ccagggggagugagcgcuucc

SEQ ID NO: 772 - RNA, 22 nt, Artificial Sequence
  Targeting Domain
uccagggggagugagcgcuucc

SEQ ID NO: 773 - RNA, 23 nt, Artificial Sequence
  Targeting Domain
guccagggggagugagcgcuucc

SEQ ID NO: 774 - RNA, 24 nt, Artificial Sequence
  Targeting Domain
cguccagggggagugagcgcuucc

SEQ ID NO: 775 - RNA, 18 nt, Artificial Sequence
  Targeting Domain
gugagccuugcucgaggc

SEQ ID NO: 776 - RNA, 19 nt, Artificial Sequence
  Targeting Domain
cgugagccuugcucgaggc

SEQ ID NO: 777 - RNA, 20 nt, Artificial Sequence
  Targeting Domain
acgugagccuugcucgaggc

SEQ ID NO: 778 - RNA, 21 nt, Artificial Sequence
  Targeting Domain
cacgugagccuugcucgaggc

SEQ ID NO: 779 - RNA, 22 nt, Artificial Sequence
  Targeting Domain
ccacgugagccuugcucgaggc

SEQ ID NO: 780 - RNA, 23 nt, Artificial Sequence
  Targeting Domain
uccacgugagccuugcucgaggc

SEQ ID NO: 781 - RNA, 24 nt, Artificial Sequence
  Targeting Domain
guccacgugagccuugcucgaggc

SEQ ID NO: 782 - RNA, 18 nt, Artificial Sequence
  Targeting Domain
ggagaggaugugcagggc

SEQ ID NO: 783 - RNA, 19 nt, Artificial Sequence
  Targeting Domain
gggagaggaugugcagggc

SEQ ID NO: 784 - RNA, 20 nt, Artificial Sequence
  Targeting Domain
agggagaggaugugcagggc

SEQ ID NO: 785 - RNA, 21 nt, Artificial Sequence
  Targeting Domain
gagggagaggaugugcagggc

SEQ ID NO: 786 - RNA, 22 nt, Artificial Sequence
  Targeting Domain
ggagggagaggaugugcagggc

SEQ ID NO: 787 - RNA, 23 nt, Artificial Sequence
  Targeting Domain
gggagggagaggaugugcagggc

SEQ ID NO: 788 - RNA, 24 nt, Artificial Sequence
  Targeting Domain
agggagggagaggaugugcagggc

SEQ ID NO: 789 - RNA, 18 nt, Artificial Sequence
  Targeting Domain
gaaagggacugaagcugc

SEQ ID NO: 790 - RNA, 19 nt, Artificial Sequence
  Targeting Domain
agaaagggacugaagcugc

SEQ ID NO: 791 - RNA, 21 nt, Artificial Sequence
  Targeting Domain
caagaaagggacugaagcugc

SEQ ID NO: 792 - RNA, 22 nt, Artificial Sequence
  Targeting Domain
acaagaaagggacugaagcugc

SEQ ID NO: 793 - RNA, 23 nt, Artificial Sequence
  Targeting Domain
gacaagaaagggacugaagcugc

SEQ ID NO: 794 - RNA, 24 nt, Artificial Sequence
  Targeting Domain
cgacaagaaagggacugaagcugc

SEQ ID NO: 795 - RNA, 18 nt, Artificial Sequence
  Targeting Domain
uguccacgugagccuugc

SEQ ID NO: 796 - RNA, 19 nt, Artificial Sequence
  Targeting Domain
guguccacgugagccuugc

SEQ ID NO: 797 - RNA, 20 nt, Artificial Sequence
  Targeting Domain
gguguccacgugagccuugc

SEQ ID NO: 798 - RNA, 21 nt, Artificial Sequence
  Targeting Domain
agguguccacgugagccuugc

SEQ ID NO: 799 - RNA, 22 nt, Artificial Sequence
  Targeting Domain
gagguguccacgugagccuugc

SEQ ID NO: 800 - RNA, 23 nt, Artificial Sequence
  Targeting Domain
ggagguguccacgugagccuugc

SEQ ID NO: 801 - RNA, 24 nt, Artificial Sequence
  Targeting Domain
gggagguguccacgugagccuugc

SEQ ID NO: 802 - RNA, 18 nt, Artificial Sequence
  Targeting Domain
ugcagggccagggccguc

SEQ ID NO: 803 - RNA, 19 nt, Artificial Sequence
  Targeting Domain
gugcagggccagggccguc

SEQ ID NO: 804 - RNA, 20 nt, Artificial Sequence
  Targeting Domain
ugugcagggccagggccguc

SEQ ID NO: 805 - RNA, 21 nt, Artificial Sequence
  Targeting Domain
augugcagggccagggccguc

SEQ ID NO: 806 - RNA, 22 nt, Artificial Sequence
  Targeting Domain
gaugugcagggccagggccguc

SEQ ID NO: 807 - RNA, 23 nt, Artificial Sequence
  Targeting Domain
ggaugugcagggccagggccguc

SEQ ID NO: 808 - RNA, 24 nt, Artificial Sequence
  Targeting Domain
aggaugugcagggccagggccguc

SEQ ID NO: 809 - RNA, 18 nt, Artificial Sequence
  Targeting Domain
agggggagugagcgcuuc

SEQ ID NO: 810 - RNA, 19 nt, Artificial Sequence
  Targeting Domain
cagggggagugagcgcuuc

SEQ ID NO: 811 - RNA, 20 nt, Artificial Sequence
  Targeting Domain
ccagggggagugagcgcuuc

SEQ ID NO: 812 - RNA, 21 nt, Artificial Sequence
  Targeting Domain
uccagggggagugagcgcuuc

SEQ ID NO: 813 - RNA, 22 nt, Artificial Sequence
  Targeting Domain
guccagggggagugagcgcuuc

SEQ ID NO: 814 - RNA, 23 nt, Artificial Sequence
  Targeting Domain
cguccagggggagugagcgcuuc

SEQ ID NO: 815 - RNA, 24 nt, Artificial Sequence
  Targeting Domain
ccguccagggggagugagcgcuuc

SEQ ID NO: 816 - RNA, 18 nt, Artificial Sequence
  Targeting Domain
accaagucuccccucuuc

SEQ ID NO: 817 - RNA, 19 nt, Artificial Sequence
  Targeting Domain
uaccaagucuccccucuuc

SEQ ID NO: 818 - RNA, 20 nt, Artificial Sequence
  Targeting Domain
auaccaagucuccccucuuc

SEQ ID NO: 819 - RNA, 21 nt, Artificial Sequence
  Targeting Domain
aauaccaagucuccccucuuc

SEQ ID NO: 820 - RNA, 22 nt, Artificial Sequence
  Targeting Domain
aaauaccaagucuccccucuuc

SEQ ID NO: 821 - RNA, 23 nt, Artificial Sequence
  Targeting Domain
aaaauaccaagucuccccucuuc

SEQ ID NO: 822 - RNA, 24 nt, Artificial Sequence
  Targeting Domain
caaaauaccaagucuccccucuuc

SEQ ID NO: 823 - RNA, 18 nt, Artificial Sequence
  Targeting Domain
agggccagggccguccag

SEQ ID NO: 824 - RNA, 19 nt, Artificial Sequence
  Targeting Domain
cagggccagggccguccag

SEQ ID NO: 825 - RNA, 21 nt, Artificial Sequence
  Targeting Domain
ugcagggccagggccguccag

SEQ ID NO: 826 - RNA, 22 nt, Artificial Sequence
  Targeting Domain
gugcagggccagggccguccag

SEQ ID NO: 827 - RNA, 23 nt, Artificial Sequence
  Targeting Domain
ugugcagggccagggccguccag

SEQ ID NO: 828 - RNA, 24 nt, Artificial Sequence
  Targeting Domain
augugcagggccagggccguccag

SEQ ID NO: 829 - RNA, 18 nt, Artificial Sequence
  Targeting Domain
caaggccuaugugacagg

SEQ ID NO: 830 - RNA, 19 nt, Artificial Sequence
  Targeting Domain
gcaaggccuaugugacagg

SEQ ID NO: 831 - RNA, 20 nt, Artificial Sequence
  Targeting Domain
agcaaggccuaugugacagg

SEQ ID NO: 832 - RNA, 21 nt, Artificial Sequence
  Targeting Domain
gagcaaggccuaugugacagg

SEQ ID NO: 833 - RNA, 22 nt, Artificial Sequence
  Targeting Domain
ggagcaaggccuaugugacagg

SEQ ID NO: 834 - RNA, 23 nt, Artificial Sequence
  Targeting Domain
aggagcaaggccuaugugacagg

SEQ ID NO: 835 - RNA, 24 nt, Artificial Sequence
  Targeting Domain
gaggagcaaggccuaugugacagg

SEQ ID NO: 836 - RNA, 18 nt, Artificial Sequence
  Targeting Domain
gccuaugugacagggagg

SEQ ID NO: 837 - RNA, 19 nt, Artificial Sequence
  Targeting Domain
ggccuaugugacagggagg

SEQ ID NO: 838 - RNA, 20 nt, Artificial Sequence
  Targeting Domain
aggccuaugugacagggagg

SEQ ID NO: 839 - RNA, 21 nt, Artificial Sequence
  Targeting Domain
aaggccuaugugacagggagg

SEQ ID NO: 840 - RNA, 22 nt, Artificial Sequence
  Targeting Domain
caaggccuaugugacagggagg

SEQ ID NO: 841 - RNA, 23 nt, Artificial Sequence
  Targeting Domain
gcaaggccuaugugacagggagg

SEQ ID NO: 842 - RNA, 24 nt, Artificial Sequence
  Targeting Domain
agcaaggccuaugugacagggagg

SEQ ID NO: 843 - RNA, 18 nt, Artificial Sequence
  Targeting Domain
ucagccaaagccuugagg

SEQ ID NO: 844 - RNA, 19 nt, Artificial Sequence
  Targeting Domain
aucagccaaagccuugagg

SEQ ID NO: 845 - RNA, 18 nt, Artificial Sequence
  Targeting Domain
aaggccuaugugacaggg

SEQ ID NO: 846 - RNA, 19 nt, Artificial Sequence
  Targeting Domain
caaggccuaugugacaggg

SEQ ID NO: 847 - RNA, 21 nt, Artificial Sequence
  Targeting Domain
agcaaggccuaugugacaggg

SEQ ID NO: 848 - RNA, 22 nt, Artificial Sequence
  Targeting Domain
gagcaaggccuaugugacaggg

SEQ ID NO: 849 - RNA, 23 nt, Artificial Sequence
  Targeting Domain
ggagcaaggccuaugugacaggg

SEQ ID NO: 850 - RNA, 24 nt, Artificial Sequence
  Targeting Domain
aggagcaaggccuaugugacaggg

SEQ ID NO: 851 - RNA, 18 nt, Artificial Sequence
  Targeting Domain
agaaagggacugaagcug

SEQ ID NO: 852 - RNA, 19 nt, Artificial Sequence
  Targeting Domain
aagaaagggacugaagcug

SEQ ID NO: 853 - RNA, 20 nt, Artificial Sequence
  Targeting Domain
caagaaagggacugaagcug

SEQ ID NO: 854 - RNA, 21 nt, Artificial Sequence
  Targeting Domain
acaagaaagggacugaagcug

SEQ ID NO: 855 - RNA, 22 nt, Artificial Sequence
  Targeting Domain
gacaagaaagggacugaagcug

SEQ ID NO: 856 - RNA, 23 nt, Artificial Sequence
  Targeting Domain
cgacaagaaagggacugaagcug

SEQ ID NO: 857 - RNA, 24 nt, Artificial Sequence
  Targeting Domain
ucgacaagaaagggacugaagcug

SEQ ID NO: 858 - RNA, 18 nt, Artificial Sequence
  Targeting Domain
agggagggagaggaugug

SEQ ID NO: 859 - RNA, 19 nt, Artificial Sequence
  Targeting Domain
cagggagggagaggaugug

SEQ ID NO: 860 - RNA, 20 nt, Artificial Sequence
  Targeting Domain
acagggagggagaggaugug

SEQ ID NO: 861 - RNA, 21 nt, Artificial Sequence
  Targeting Domain
gacagggagggagaggaugug

SEQ ID NO: 862 - RNA, 22 nt, Artificial Sequence
  Targeting Domain
ugacagggagggagaggaugug

SEQ ID NO: 863 - RNA, 23 nt, Artificial Sequence
  Targeting Domain
gugacagggagggagaggaugug

SEQ ID NO: 864 - RNA, 24 nt, Artificial Sequence
  Targeting Domain
ugugacagggagggagaggaugug

SEQ ID NO: 865 - RNA, 18 nt, Artificial Sequence
  Targeting Domain
caagucuccccucuucau

SEQ ID NO: 866 - RNA, 19 nt, Artificial Sequence
  Targeting Domain
ccaagucuccccucuucau

SEQ ID NO: 867 - RNA, 21 nt, Artificial Sequence
  Targeting Domain
uaccaagucuccccucuucau

SEQ ID NO: 868 - RNA, 22 nt, Artificial Sequence
  Targeting Domain
auaccaagucuccccucuucau

SEQ ID NO: 869 - RNA, 23 nt, Artificial Sequence
  Targeting Domain
aauaccaagucuccccucuucau

SEQ ID NO: 870 - RNA, 24 nt, Artificial Sequence
  Targeting Domain
aaauaccaagucuccccucuucau

SEQ ID NO: 871 - RNA, 18 nt, Artificial Sequence
  Targeting Domain
ggggagugagcgcuuccu

SEQ ID NO: 872 - RNA, 19 nt, Artificial Sequence
  Targeting Domain
gggggagugagcgcuuccu

SEQ ID NO: 873 - RNA, 21 nt, Artificial Sequence
  Targeting Domain
cagggggagugagcgcuuccu

SEQ ID NO: 874 - RNA, 22 nt, Artificial Sequence
  Targeting Domain
ccagggggagugagcgcuuccu

SEQ ID NO: 875 - RNA, 23 nt, Artificial Sequence
  Targeting Domain
uccagggggagugagcgcuuccu

SEQ ID NO: 876 - RNA, 24 nt, Artificial Sequence
  Targeting Domain
guccagggggagugagcgcuuccu

SEQ ID NO: 877 - RNA, 18 nt, Artificial Sequence
  Targeting Domain
cugcuggggccauguuuu

SEQ ID NO: 878 - RNA, 19 nt, Artificial Sequence
  Targeting Domain
gcugcuggggccauguuuu

SEQ ID NO: 879 - RNA, 20 nt, Artificial Sequence
  Targeting Domain
agcugcuggggccauguuuu

SEQ ID NO: 880 - RNA, 21 nt, Artificial Sequence
  Targeting Domain
aagcugcuggggccauguuuu

SEQ ID NO: 881 - RNA, 22 nt, Artificial Sequence
  Targeting Domain
gaagcugcuggggccauguuuu

SEQ ID NO: 882 - RNA, 23 nt, Artificial Sequence
  Targeting Domain
ugaagcugcuggggccauguuuu

SEQ ID NO: 883 - RNA, 24 nt, Artificial Sequence
  Targeting Domain
cugaagcugcuggggccauguuuu

SEQ ID NO: 884 - RNA, 20 nt, Artificial Sequence
  Targeting Domain
gaauuucuuuucugcacgac

SEQ ID NO: 885 - RNA, 20 nt, Artificial Sequence
  Targeting Domain
cagaucauagguuccaguaa

SEQ ID NO: 886 - RNA, 20 nt, Artificial Sequence
  Targeting Domain
uuacccaaacuguccauuac

SEQ ID NO: 887 - RNA, 20 nt, Artificial Sequence
  Targeting Domain
cuaugaucugaagagcgucc

SEQ ID NO: 888 - RNA, 20 nt, Artificial Sequence
  Targeting Domain
caguuuggguaaauguaagc

SEQ ID NO: 889 - RNA, 20 nt, Artificial Sequence
  Targeting Domain
cucaccuuggagagcuucag

SEQ ID NO: 890 - RNA, 20 nt, Artificial Sequence
  Targeting Domain
caauggggcugaccucuccg

SEQ ID NO: 891 - RNA, 20 nt, Artificial Sequence
  Targeting Domain
aagagcguccugggucaacu

SEQ ID NO: 892 - RNA, 20 nt, Artificial Sequence
  Targeting Domain
uaugaucugaagagcguccu

SEQ ID NO: 893 - RNA, 17 nt, Artificial Sequence
  Targeting Domain
gugcaacaaggucguca

SEQ ID NO: 894 - RNA, 17 nt, Artificial Sequence
  Targeting Domain
gagcguccugggucaac

SEQ ID NO: 895 - RNA, 17 nt, Artificial Sequence
  Targeting Domain
ggugcaacaaggucguc

SEQ ID NO: 896 - RNA, 17 nt, Artificial Sequence
  Targeting Domain
gacgcucuucagaucau

SEQ ID NO: 897 - RNA, 17 nt, Artificial Sequence
  Targeting Domain
gaucugaagagcguccu

SEQ ID NO: 898 - RNA, 20 nt, Artificial Sequence
  Targeting Domain
ggcaccccugaagcucucca

SEQ ID NO: 899 - RNA, 20 nt, Artificial Sequence
  Targeting Domain
gggucaacugggcaucacua

SEQ ID NO: 900 - RNA, 20 nt, Artificial Sequence
  Targeting Domain
gaagagcguccugggucaac

SEQ ID NO: 901 - RNA, 20 nt, Artificial Sequence
  Targeting Domain
gggugccuccucugugaccc

SEQ ID NO: 902 - RNA, 20 nt, Artificial Sequence
  Targeting Domain
gcaauggggcugaccucucc

SEQ ID NO: 903 - RNA, 20 nt, Artificial Sequence
  Targeting Domain
gguuccaguaauggacaguu

SEQ ID NO: 904 - RNA, 20 nt, Artificial Sequence
  Targeting Domain
guuccaguaauggacaguuu

SEQ ID NO: 905 - RNA, 17 nt, Artificial Sequence
  Targeting Domain
acuaaggucuucagcaa

SEQ ID NO: 906 - RNA, 17 nt, Artificial Sequence
  Targeting Domain
aucauagguuccaguaa

SEQ ID NO: 907 - RNA, 17 nt, Artificial Sequence
  Targeting Domain
accccugaagcucucca

SEQ ID NO: 908 - RNA, 17 nt, Artificial Sequence
  Targeting Domain
ugcagaaaagaaauuca

SEQ ID NO: 909 - RNA, 17 nt, Artificial Sequence
  Targeting Domain
caccuuggagagcuuca

SEQ ID NO: 910 - RNA, 17 nt, Artificial Sequence
  Targeting Domain
ucaacugggcaucacua

SEQ ID NO: 911 - RNA, 17 nt, Artificial Sequence
  Targeting Domain
uuucuuuucugcacgac

SEQ ID NO: 912 - RNA, 17 nt, Artificial Sequence
  Targeting Domain
cccaaacuguccauuac

SEQ ID NO: 913 - RNA, 17 nt, Artificial Sequence
  Targeting Domain
ugccuccucugugaccc

SEQ ID NO: 914 - RNA, 17 nt, Artificial Sequence
  Targeting Domain
ugaugcccaguugaccc

SEQ ID NO: 915 - RNA, 17 nt, Artificial Sequence
  Targeting Domain
auggggcugaccucucc

SEQ ID NO: 916 - RNA, 17 nt, Artificial Sequence
  Targeting Domain
ugaucugaagagcgucc

SEQ ID NO: 917 - RNA, 17 nt, Artificial Sequence
  Targeting Domain
uuuggguaaauguaagc

SEQ ID NO: 918 - RNA, 17 nt, Artificial Sequence
  Targeting Domain
aauggggcugaccucuc

SEQ ID NO: 919 - RNA, 17 nt, Artificial Sequence
  Targeting Domain
ucaccuuggagagcuuc

SEQ ID NO: 920 - RNA, 17 nt, Artificial Sequence
  Targeting Domain
ccucuccggggucacag

SEQ ID NO: 921 - RNA, 17 nt, Artificial Sequence
  Targeting Domain
accuuggagagcuucag

SEQ ID NO: 922 - RNA, 17 nt, Artificial Sequence
  Targeting Domain
ccucugugaccccggag

SEQ ID NO: 923 - RNA, 17 nt, Artificial Sequence
  Targeting Domain
uggggcugaccucuccg

SEQ ID NO: 924 - RNA, 17 nt, Artificial Sequence
  Targeting Domain
cuccggggucacagagg

SEQ ID NO: 925 - RNA, 17 nt, Artificial Sequence
  Targeting Domain
uaaggucuucagcaaug

SEQ ID NO: 926 - RNA, 17 nt, Artificial Sequence
  Targeting Domain
cuaaggucuucagcaau

SEQ ID NO: 927 - RNA, 17 nt, Artificial Sequence
  Targeting Domain
agcguccugggucaacu

SEQ ID NO: 928 - RNA, 17 nt, Artificial Sequence
  Targeting Domain
ucagggugaucucaccu

SEQ ID NO: 929 - RNA, 17 nt, Artificial Sequence
  Targeting Domain
uccaguaauggacaguu

SEQ ID NO: 930 - RNA, 17 nt, Artificial Sequence
  Targeting Domain
ccaguaauggacaguuu

SEQ ID NO: 931 - RNA, 20 nt, Artificial Sequence
  Targeting Domain
aucacuaaggucuucagcaa

SEQ ID NO: 932 - RNA, 20 nt, Artificial Sequence
  Targeting Domain
ucgugcagaaaagaaauuca

SEQ ID NO: 933 - RNA, 20 nt, Artificial Sequence
  Targeting Domain
ucucaccuuggagagcuuca

SEQ ID NO: 934 - RNA, 20 nt, Artificial Sequence
  Targeting Domain
uagugaugcccaguugaccc

SEQ ID NO: 935 - RNA, 20 nt, Artificial Sequence
  Targeting Domain
agcaauggggcugaccucuc

SEQ ID NO: 936 - RNA, 20 nt, Artificial Sequence
  Targeting Domain
aucucaccuuggagagcuuc

SEQ ID NO: 937 - RNA, 20 nt, Artificial Sequence
  Targeting Domain
ugaccucuccggggucacag

SEQ ID NO: 938 - RNA, 20 nt, Artificial Sequence
  Targeting Domain
ccuccucugugaccccggag

SEQ ID NO: 939 - RNA, 20 nt, Artificial Sequence
  Targeting Domain
ccucuccggggucacagagg

SEQ ID NO: 940 - RNA, 20 nt, Artificial Sequence
  Targeting Domain
cacuaaggucuucagcaaug

SEQ ID NO: 941 - RNA, 20 nt, Artificial Sequence
  Targeting Domain
ucacuaaggucuucagcaau

SEQ ID NO: 942 - RNA, 20 nt, Artificial Sequence
  Targeting Domain
caggacgcucuucagaucau

SEQ ID NO: 943 - RNA, 20 nt, Artificial Sequence
  Targeting Domain
ucgucagggugaucucaccu

SEQ ID NO: 944 - RNA, 21 nt, Artificial Sequence
  Targeting Domain
gaucucaccuuggagagcuuc

SEQ ID NO: 945 - RNA, 23 nt, Artificial Sequence
  Targeting Domain
gugaucucaccuuggagagcuuc

SEQ ID NO: 946 - RNA, 24 nt, Artificial Sequence
  Targeting Domain
ggugaucucaccuuggagagcuuc

SEQ ID NO: 947 - RNA, 19 nt, Artificial Sequence
  Targeting Domain
gcaauggggcugaccucuc

SEQ ID NO: 948 - RNA, 23 nt, Artificial Sequence
  Targeting Domain
gaaccuaugaucugaagagcguc

SEQ ID NO: 949 - RNA, 24 nt, Artificial Sequence
  Targeting Domain
ggaaccuaugaucugaagagcguc

SEQ ID NO: 950 - RNA, 22 nt, Artificial Sequence
  Targeting Domain
ugaucucaccuuggagagcuuc

SEQ ID NO: 951 - RNA, 21 nt, Artificial Sequence
  Targeting Domain
uagguuccaguaauggacagu

SEQ ID NO: 952 - RNA, 22 nt, Artificial Sequence
  Targeting Domain
auagguuccaguaauggacagu

SEQ ID NO: 953 - RNA, 23 nt, Artificial Sequence
  Targeting Domain
cauagguuccaguaauggacagu

SEQ ID NO: 954 - RNA, 24 nt, Artificial Sequence
  Targeting Domain
ucauagguuccaguaauggacagu

SEQ ID NO: 955 - RNA, 18 nt, Artificial Sequence
  Targeting Domain
caauggggcugaccucuc

SEQ ID NO: 956 - RNA, 21 nt, Artificial Sequence
  Targeting Domain
cagcaauggggcugaccucuc

SEQ ID NO: 957 - RNA, 22 nt, Artificial Sequence
  Targeting Domain
ucagcaauggggcugaccucuc

SEQ ID NO: 958 - RNA, 23 nt, Artificial Sequence
  Targeting Domain
uucagcaauggggcugaccucuc

SEQ ID NO: 959 - RNA, 24 nt, Artificial Sequence
  Targeting Domain
cuucagcaauggggcugaccucuc

SEQ ID NO: 960 - RNA, 18 nt, Artificial Sequence
  Targeting Domain
uaugaucugaagagcguc

SEQ ID NO: 961 - RNA, 19 nt, Artificial Sequence
  Targeting Domain
cuaugaucugaagagcguc

SEQ ID NO: 962 - RNA, 20 nt, Artificial Sequence
  Targeting Domain
ccuaugaucugaagagcguc

SEQ ID NO: 963 - RNA, 21 nt, Artificial Sequence
  Targeting Domain
accuaugaucugaagagcguc

SEQ ID NO: 964 - RNA, 22 nt, Artificial Sequence
  Targeting Domain
aaccuaugaucugaagagcguc

SEQ ID NO: 965 - RNA, 18 nt, Artificial Sequence
  Targeting Domain
guuccaguaauggacagu

SEQ ID NO: 966 - RNA, 19 nt, Artificial Sequence
  Targeting Domain
gguuccaguaauggacagu

SEQ ID NO: 967 - RNA, 18 nt, Artificial Sequence
  Targeting Domain
cucaccuuggagagcuuc

SEQ ID NO: 968 - RNA, 19 nt, Artificial Sequence
  Targeting Domain
ucucaccuuggagagcuuc

SEQ ID NO: 969 - RNA, 20 nt, Artificial Sequence
  Targeting Domain
agguuccaguaauggacagu

SEQ ID NO: 970 - RNA, 18 nt, Artificial Sequence
  Targeting Domain
cagaccugucgugcagaa

SEQ ID NO: 971 - RNA, 19 nt, Artificial Sequence
  Targeting Domain
gcagaccugucgugcagaa

SEQ ID NO: 972 - RNA, 20 nt, Artificial Sequence
  Targeting Domain
ggcagaccugucgugcagaa

SEQ ID NO: 973 - RNA, 21 nt, Artificial Sequence
  Targeting Domain
uggcagaccugucgugcagaa

SEQ ID NO: 974 - RNA, 22 nt, Artificial Sequence
  Targeting Domain
cuggcagaccugucgugcagaa

SEQ ID NO: 975 - RNA, 23 nt, Artificial Sequence
  Targeting Domain
gcuggcagaccugucgugcagaa

SEQ ID NO: 976 - RNA, 24 nt, Artificial Sequence
  Targeting Domain
agcuggcagaccugucgugcagaa

SEQ ID NO: 977 - RNA, 18 nt, Artificial Sequence
  Targeting Domain
agaucauagguuccagua

SEQ ID NO: 978 - RNA, 19 nt, Artificial Sequence
  Targeting Domain
cagaucauagguuccagua

SEQ ID NO: 979 - RNA, 20 nt, Artificial Sequence
  Targeting Domain
ucagaucauagguuccagua

SEQ ID NO: 980 - RNA, 21 nt, Artificial Sequence
  Targeting Domain
uucagaucauagguuccagua

SEQ ID NO: 981 - RNA, 22 nt, Artificial Sequence
  Targeting Domain
cuucagaucauagguuccagua

SEQ ID NO: 982 - RNA, 23 nt, Artificial Sequence
  Targeting Domain
ucuucagaucauagguuccagua

SEQ ID NO: 983 - RNA, 24 nt, Artificial Sequence
  Targeting Domain
cucuucagaucauagguuccagua

SEQ ID NO: 984 - RNA, 18 nt, Artificial Sequence
  Targeting Domain
cgucagggugaucucacc

SEQ ID NO: 985 - RNA, 19 nt, Artificial Sequence
  Targeting Domain
ucgucagggugaucucacc

SEQ ID NO: 986 - RNA, 20 nt, Artificial Sequence
  Targeting Domain
gucgucagggugaucucacc

SEQ ID NO: 987 - RNA, 21 nt, Artificial Sequence
  Targeting Domain
ggucgucagggugaucucacc

SEQ ID NO: 988 - RNA, 22 nt, Artificial Sequence
  Targeting Domain
aggucgucagggugaucucacc

SEQ ID NO: 989 - RNA, 23 nt, Artificial Sequence
  Targeting Domain
aaggucgucagggugaucucacc

SEQ ID NO: 990 - RNA, 24 nt, Artificial Sequence
  Targeting Domain
caaggucgucagggugaucucacc

SEQ ID NO: 991 - RNA, 18 nt, Artificial Sequence
  Targeting Domain
ggugccuccucugugacc

SEQ ID NO: 992 - RNA, 19 nt, Artificial Sequence
  Targeting Domain
gggugccuccucugugacc

SEQ ID NO: 993 - RNA, 20 nt, Artificial Sequence
  Targeting Domain
ggggugccuccucugugacc

SEQ ID NO: 994 - RNA, 21 nt, Artificial Sequence
  Targeting Domain
aggggugccuccucugugacc

SEQ ID NO: 995 - RNA, 22 nt, Artificial Sequence
  Targeting Domain
caggggugccuccucugugacc

SEQ ID NO: 996 - RNA, 23 nt, Artificial Sequence
  Targeting Domain
ucaggggugccuccucugugacc

SEQ ID NO: 997 - RNA, 24 nt, Artificial Sequence
  Targeting Domain
uucaggggugccuccucugugacc

SEQ ID NO: 998 - RNA, 18 nt, Artificial Sequence
  Targeting Domain
agugaugcccaguugacc

SEQ ID NO: 999 - RNA, 19 nt, Artificial Sequence
  Targeting Domain
uagugaugcccaguugacc

SEQ ID NO: 1000 - RNA, 20 nt, Artificial Sequence
  Targeting Domain
uuagugaugcccaguugacc

SEQ ID NO: 1001 - RNA, 21 nt, Artificial Sequence
  Targeting Domain
cuuagugaugcccaguugacc

SEQ ID NO: 1002 - RNA, 22 nt, Artificial Sequence
  Targeting Domain
ccuuagugaugcccaguugacc

SEQ ID NO: 1003 - RNA, 23 nt, Artificial Sequence
  Targeting Domain
accuuagugaugcccaguugacc

SEQ ID NO: 1004 - RNA, 24 nt, Artificial Sequence
  Targeting Domain
gaccuuagugaugcccaguugacc

SEQ ID NO: 1005 - RNA, 18 nt, Artificial Sequence
  Targeting Domain
gugccuccucugugaccc

SEQ ID NO: 1006 - RNA, 19 nt, Artificial Sequence
  Targeting Domain
ggugccuccucugugaccc

SEQ ID NO: 1007 - RNA, 21 nt, Artificial Sequence
  Targeting Domain
ggggugccuccucugugaccc

SEQ ID NO: 1008 - RNA, 22 nt, Artificial Sequence
  Targeting Domain
aggggugccuccucugugaccc

SEQ ID NO: 1009 - RNA, 23 nt, Artificial Sequence
  Targeting Domain
caggggugccuccucugugaccc

SEQ ID NO: 1010 - RNA, 24 nt, Artificial Sequence
  Targeting Domain
ucaggggugccuccucugugaccc

SEQ ID NO: 1011 - RNA, 18 nt, Artificial Sequence
  Targeting Domain
gccuccucugugaccccg

SEQ ID NO: 1012 - RNA, 19 nt, Artificial Sequence
  Targeting Domain
ugccuccucugugaccccg

SEQ ID NO: 1013 - RNA, 20 nt, Artificial Sequence
  Targeting Domain
gugccuccucugugaccccg

SEQ ID NO: 1014 - RNA, 21 nt, Artificial Sequence
  Targeting Domain
ggugccuccucugugaccccg

SEQ ID NO: 1015 - RNA, 22 nt, Artificial Sequence
  Targeting Domain
gggugccuccucugugaccccg

SEQ ID NO: 1016 - RNA, 23 nt, Artificial Sequence
  Targeting Domain
ggggugccuccucugugaccccg

SEQ ID NO: 1017 - RNA, 24 nt, Artificial Sequence
  Targeting Domain
aggggugccuccucugugaccccg

SEQ ID NO: 1018 - RNA, 18 nt, Artificial Sequence
  Targeting Domain
gcuggcagaccugucgug

SEQ ID NO: 1019 - RNA, 19 nt, Artificial Sequence
  Targeting Domain
agcuggcagaccugucgug

SEQ ID NO: 1020 - RNA, 20 nt, Artificial Sequence
  Targeting Domain
aagcuggcagaccugucgug

SEQ ID NO: 1021 - RNA, 21 nt, Artificial Sequence
  Targeting Domain
uaagcuggcagaccugucgug

SEQ ID NO: 1022 - RNA, 22 nt, Artificial Sequence
  Targeting Domain
guaagcuggcagaccugucgug

SEQ ID NO: 1023 - RNA, 23 nt, Artificial Sequence
  Targeting Domain
uguaagcuggcagaccugucgug

SEQ ID NO: 1024 - RNA, 24 nt, Artificial Sequence
  Targeting Domain
auguaagcuggcagaccugucgug

SEQ ID NO: 1025 - RNA, 18 nt, Artificial Sequence
  Targeting Domain
gagaggucagccccauug

SEQ ID NO: 1026 - RNA, 19 nt, Artificial Sequence
  Targeting Domain
ggagaggucagccccauug

SEQ ID NO: 1027 - RNA, 20 nt, Artificial Sequence
  Targeting Domain
cggagaggucagccccauug

SEQ ID NO: 1028 - RNA, 21 nt, Artificial Sequence
  Targeting Domain
ccggagaggucagccccauug

SEQ ID NO: 1029 - RNA, 22 nt, Artificial Sequence
  Targeting Domain
cccggagaggucagccccauug

SEQ ID NO: 1030 - RNA, 23 nt, Artificial Sequence
  Targeting Domain
ccccggagaggucagccccauug

SEQ ID NO: 1031 - RNA, 24 nt, Artificial Sequence
  Targeting Domain
accccggagaggucagccccauug

SEQ ID NO: 1032 - RNA, 18 nt, Artificial Sequence
  Targeting Domain
cagggugaucucaccuug

SEQ ID NO: 1033 - RNA, 19 nt, Artificial Sequence
  Targeting Domain
ucagggugaucucaccuug

SEQ ID NO: 1034 - RNA, 20 nt, Artificial Sequence
  Targeting Domain
gucagggugaucucaccuug

SEQ ID NO: 1035 - RNA, 21 nt, Artificial Sequence
  Targeting Domain
cgucagggugaucucaccuug

SEQ ID NO: 1036 - RNA, 22 nt, Artificial Sequence
  Targeting Domain
ucgucagggugaucucaccuug

SEQ ID NO: 1037 - RNA, 23 nt, Artificial Sequence
  Targeting Domain
gucgucagggugaucucaccuug

SEQ ID NO: 1038 - RNA, 24 nt, Artificial Sequence
  Targeting Domain
ggucgucagggugaucucaccuug

SEQ ID NO: 1039 - RNA, 18 nt, Artificial Sequence
  Targeting Domain
gucagggugaucucaccu

SEQ ID NO: 1040 - RNA, 19 nt, Artificial Sequence
  Targeting Domain
cgucagggugaucucaccu

SEQ ID NO: 1041 - RNA, 21 nt, Artificial Sequence
  Targeting Domain
gucgucagggugaucucaccu

SEQ ID NO: 1042 - RNA, 22 nt, Artificial Sequence
  Targeting Domain
ggucgucagggugaucucaccu

SEQ ID NO: 1043 - RNA, 23 nt, Artificial Sequence
  Targeting Domain
aggucgucagggugaucucaccu

SEQ ID NO: 1044 - RNA, 24 nt, Artificial Sequence
  Targeting Domain
aaggucgucagggugaucucaccu

SEQ ID NO: 1045 - RNA, 18 nt, Artificial Sequence
  Targeting Domain
ucucaccuuggagagcuu

SEQ ID NO: 1046 - RNA, 19 nt, Artificial Sequence
  Targeting Domain
aucucaccuuggagagcuu

SEQ ID NO: 1047 - RNA, 20 nt, Artificial Sequence
  Targeting Domain
gaucucaccuuggagagcuu

SEQ ID NO: 1048 - RNA, 21 nt, Artificial Sequence
  Targeting Domain
ugaucucaccuuggagagcuu

SEQ ID NO: 1049 - RNA, 22 nt, Artificial Sequence
  Targeting Domain
gugaucucaccuuggagagcuu

SEQ ID NO: 1050 - RNA, 23 nt, Artificial Sequence
  Targeting Domain
ggugaucucaccuuggagagcuu

SEQ ID NO: 1051 - RNA, 24 nt, Artificial Sequence
  Targeting Domain
gggugaucucaccuuggagagcuu

SEQ ID NO: 1052 - RNA, 18 nt, Artificial Sequence
  Targeting Domain
cacuaaggucuucagcaa

SEQ ID NO: 1053 - RNA, 19 nt, Artificial Sequence
  Targeting Domain
ucacuaaggucuucagcaa

SEQ ID NO: 1054 - RNA, 21 nt, Artificial Sequence
  Targeting Domain
caucacuaaggucuucagcaa

SEQ ID NO: 1055 - RNA, 22 nt, Artificial Sequence
  Targeting Domain
gcaucacuaaggucuucagcaa

SEQ ID NO: 1056 - RNA, 23 nt, Artificial Sequence
  Targeting Domain
ggcaucacuaaggucuucagcaa

SEQ ID NO: 1057 - RNA, 24 nt, Artificial Sequence
  Targeting Domain
gggcaucacuaaggucuucagcaa

SEQ ID NO: 1058 - RNA, 18 nt, Artificial Sequence
  Targeting Domain
aagagcguccugggucaa

SEQ ID NO: 1059 - RNA, 19 nt, Artificial Sequence
  Targeting Domain
gaagagcguccugggucaa

SEQ ID NO: 1060 - RNA, 20 nt, Artificial Sequence
  Targeting Domain
ugaagagcguccugggucaa

SEQ ID NO: 1061 - RNA, 21 nt, Artificial Sequence
  Targeting Domain
cugaagagcguccugggucaa

SEQ ID NO: 1062 - RNA, 22 nt, Artificial Sequence
  Targeting Domain
ucugaagagcguccugggucaa

SEQ ID NO: 1063 - RNA, 23 nt, Artificial Sequence
  Targeting Domain
aucugaagagcguccugggucaa

SEQ ID NO: 1064 - RNA, 24 nt, Artificial Sequence
  Targeting Domain
gaucugaagagcguccugggucaa

SEQ ID NO: 1065 - RNA, 18 nt, Artificial Sequence
  Targeting Domain
gaccucuccggggucaca

SEQ ID NO: 1066 - RNA, 19 nt, Artificial Sequence
  Targeting Domain
ugaccucuccggggucaca

SEQ ID NO: 1067 - RNA, 20 nt, Artificial Sequence
  Targeting Domain
cugaccucuccggggucaca

SEQ ID NO: 1068 - RNA, 21 nt, Artificial Sequence
  Targeting Domain
gcugaccucuccggggucaca

SEQ ID NO: 1069 - RNA, 22 nt, Artificial Sequence
  Targeting Domain
ggcugaccucuccggggucaca

SEQ ID NO: 1070 - RNA, 23 nt, Artificial Sequence
  Targeting Domain
gggcugaccucuccggggucaca

SEQ ID NO: 1071 - RNA, 24 nt, Artificial Sequence
  Targeting Domain
ggggcugaccucuccggggucaca

SEQ ID NO: 1072 - RNA, 18 nt, Artificial Sequence
  Targeting Domain
ucacuaaggucuucagca

SEQ ID NO: 1073 - RNA, 19 nt, Artificial Sequence
  Targeting Domain
aucacuaaggucuucagca

SEQ ID NO: 1074 - RNA, 20 nt, Artificial Sequence
  Targeting Domain
caucacuaaggucuucagca

SEQ ID NO: 1075 - RNA, 21 nt, Artificial Sequence
  Targeting Domain
gcaucacuaaggucuucagca

SEQ ID NO: 1076 - RNA, 22 nt, Artificial Sequence
  Targeting Domain
ggcaucacuaaggucuucagca

SEQ ID NO: 1077 - RNA, 23 nt, Artificial Sequence
  Targeting Domain
gggcaucacuaaggucuucagca

SEQ ID NO: 1078 - RNA, 24 nt, Artificial Sequence
  Targeting Domain
ugggcaucacuaaggucuucagca

SEQ ID NO: 1079 - RNA, 18 nt, Artificial Sequence
  Targeting Domain
cugaccucuccgggguca

SEQ ID NO: 1080 - RNA, 19 nt, Artificial Sequence
  Targeting Domain
gcugaccucuccgggguca

SEQ ID NO: 1081 - RNA, 20 nt, Artificial Sequence
  Targeting Domain
ggcugaccucuccgggguca

SEQ ID NO: 1082 - RNA, 21 nt, Artificial Sequence
  Targeting Domain
gggcugaccucuccgggguca

SEQ ID NO: 1083 - RNA, 22 nt, Artificial Sequence
  Targeting Domain
ggggcugaccucuccgggguca

SEQ ID NO: 1084 - RNA, 23 nt, Artificial Sequence
  Targeting Domain
uggggcugaccucuccgggguca

SEQ ID NO: 1085 - RNA, 24 nt, Artificial Sequence
  Targeting Domain
auggggcugaccucuccgggguca

SEQ ID NO: 1086 - RNA, 18 nt, Artificial Sequence
  Targeting Domain
uacccaaacuguccauua

SEQ ID NO: 1087 - RNA, 19 nt, Artificial Sequence
  Targeting Domain
uuacccaaacuguccauua

SEQ ID NO: 1088 - RNA, 20 nt, Artificial Sequence
  Targeting Domain
uuuacccaaacuguccauua

SEQ ID NO: 1089 - RNA, 21 nt, Artificial Sequence
  Targeting Domain
auuuacccaaacuguccauua

SEQ ID NO: 1090 - RNA, 22 nt, Artificial Sequence
  Targeting Domain
cauuuacccaaacuguccauua

SEQ ID NO: 1091 - RNA, 23 nt, Artificial Sequence
  Targeting Domain
acauuuacccaaacuguccauua

SEQ ID NO: 1092 - RNA, 24 nt, Artificial Sequence
  Targeting Domain
uacauuuacccaaacuguccauua

SEQ ID NO: 1093 - RNA, 18 nt, Artificial Sequence
  Targeting Domain
acccaaacuguccauuac

SEQ ID NO: 1094 - RNA, 19 nt, Artificial Sequence
  Targeting Domain
uacccaaacuguccauuac

SEQ ID NO: 1095 - RNA, 21 nt, Artificial Sequence
  Targeting Domain
uuuacccaaacuguccauuac

SEQ ID NO: 1096 - RNA, 22 nt, Artificial Sequence
  Targeting Domain
auuuacccaaacuguccauuac

SEQ ID NO: 1097 - RNA, 23 nt, Artificial Sequence
  Targeting Domain
cauuuacccaaacuguccauuac

SEQ ID NO: 1098 - RNA, 24 nt, Artificial Sequence
  Targeting Domain
acauuuacccaaacuguccauuac

SEQ ID NO: 1099 - RNA, 18 nt, Artificial Sequence
  Targeting Domain
gucacagaggaggcaccc

SEQ ID NO: 1100 - RNA, 19 nt, Artificial Sequence
  Targeting Domain
ggucacagaggaggcaccc

SEQ ID NO: 1101 - RNA, 20 nt, Artificial Sequence
  Targeting Domain
gggucacagaggaggcaccc

SEQ ID NO: 1102 - RNA, 21 nt, Artificial Sequence
  Targeting Domain
ggggucacagaggaggcaccc

SEQ ID NO: 1103 - RNA, 22 nt, Artificial Sequence
  Targeting Domain
cggggucacagaggaggcaccc

SEQ ID NO: 1104 - RNA, 23 nt, Artificial Sequence
  Targeting Domain
ccggggucacagaggaggcaccc

SEQ ID NO: 1105 - RNA, 24 nt, Artificial Sequence
  Targeting Domain
uccggggucacagaggaggcaccc

SEQ ID NO: 1106 - RNA, 18 nt, Artificial Sequence
  Targeting Domain
ccccugaagcucuccaag

SEQ ID NO: 1107 - RNA, 19 nt, Artificial Sequence
  Targeting Domain
accccugaagcucuccaag

SEQ ID NO: 1108 - RNA, 20 nt, Artificial Sequence
  Targeting Domain
caccccugaagcucuccaag

SEQ ID NO: 1109 - RNA, 21 nt, Artificial Sequence
  Targeting Domain
gcaccccugaagcucuccaag

SEQ ID NO: 1110 - RNA, 22 nt, Artificial Sequence
  Targeting Domain
ggcaccccugaagcucuccaag

SEQ ID NO: 1111 - RNA, 23 nt, Artificial Sequence
  Targeting Domain
aggcaccccugaagcucuccaag

SEQ ID NO: 1112 - RNA, 24 nt, Artificial Sequence
  Targeting Domain
gaggcaccccugaagcucuccaag

SEQ ID NO: 1113 - RNA, 18 nt, Artificial Sequence
  Targeting Domain
accucuccggggucacag

SEQ ID NO: 1114 - RNA, 19 nt, Artificial Sequence
  Targeting Domain
gaccucuccggggucacag

SEQ ID NO: 1115 - RNA, 21 nt, Artificial Sequence
  Targeting Domain
cugaccucuccggggucacag

SEQ ID NO: 1116 - RNA, 22 nt, Artificial Sequence
  Targeting Domain
gcugaccucuccggggucacag

SEQ ID NO: 1117 - RNA, 23 nt, Artificial Sequence
  Targeting Domain
ggcugaccucuccggggucacag

SEQ ID NO: 1118 - RNA, 24 nt, Artificial Sequence
  Targeting Domain
gggcugaccucuccggggucacag

SEQ ID NO: 1119 - RNA, 18 nt, Artificial Sequence
  Targeting Domain
acuggaaccuaugaucug

SEQ ID NO: 1120 - RNA, 19 nt, Artificial Sequence
  Targeting Domain
uacuggaaccuaugaucug

SEQ ID NO: 1121 - RNA, 20 nt, Artificial Sequence
  Targeting Domain
uuacuggaaccuaugaucug

SEQ ID NO: 1122 - RNA, 21 nt, Artificial Sequence
  Targeting Domain
auuacuggaaccuaugaucug

SEQ ID NO: 1123 - RNA, 22 nt, Artificial Sequence
  Targeting Domain
cauuacuggaaccuaugaucug

SEQ ID NO: 1124 - RNA, 23 nt, Artificial Sequence
  Targeting Domain
ccauuacuggaaccuaugaucug

SEQ ID NO: 1125 - RNA, 24 nt, Artificial Sequence
  Targeting Domain
uccauuacuggaaccuaugaucug

SEQ ID NO: 1126 - RNA, 18 nt, Artificial Sequence
  Targeting Domain
auuacuggaaccuaugau

SEQ ID NO: 1127 - RNA, 19 nt, Artificial Sequence
  Targeting Domain
cauuacuggaaccuaugau

SEQ ID NO: 1128 - RNA, 20 nt, Artificial Sequence
  Targeting Domain
ccauuacuggaaccuaugau

SEQ ID NO: 1129 - RNA, 21 nt, Artificial Sequence
  Targeting Domain
uccauuacuggaaccuaugau

SEQ ID NO: 1130 - RNA, 22 nt, Artificial Sequence
  Targeting Domain
guccauuacuggaaccuaugau

SEQ ID NO: 1131 - RNA, 23 nt, Artificial Sequence
  Targeting Domain
uguccauuacuggaaccuaugau

SEQ ID NO: 1132 - RNA, 24 nt, Artificial Sequence
  Targeting Domain
cuguccauuacuggaaccuaugau

SEQ ID NO: 1133 - RNA, 18 nt, Artificial Sequence
  Targeting Domain
gcaauggggcugaccucu

SEQ ID NO: 1134 - RNA, 19 nt, Artificial Sequence
  Targeting Domain
agcaauggggcugaccucu

SEQ ID NO: 1135 - RNA, 20 nt, Artificial Sequence
  Targeting Domain
cagcaauggggcugaccucu

SEQ ID NO: 1136 - RNA, 21 nt, Artificial Sequence
  Targeting Domain
ucagcaauggggcugaccucu

SEQ ID NO: 1137 - RNA, 22 nt, Artificial Sequence
  Targeting Domain
uucagcaauggggcugaccucu

SEQ ID NO: 1138 - RNA, 23 nt, Artificial Sequence
  Targeting Domain
cuucagcaauggggcugaccucu

SEQ ID NO: 1139 - RNA, 24 nt, Artificial Sequence
  Targeting Domain
ucuucagcaauggggcugaccucu

SEQ ID NO: 1140 - RNA, 20 nt, Artificial Sequence
  Targeting Domain
gaucaacgauuacguggaga

SEQ ID NO: 1141 - RNA, 20 nt, Artificial Sequence
  Targeting Domain
gaaacagaucaacgauuacg

SEQ ID NO: 1142 - RNA, 20 nt, Artificial Sequence
  Targeting Domain
gaggaacaggccauugccgg

SEQ ID NO: 1143 - RNA, 20 nt, Artificial Sequence
  Targeting Domain
ggcuguagcgaugcucacug

SEQ ID NO: 1144 - RNA, 20 nt, Artificial Sequence
  Targeting Domain
gagccuccggaaucuccgug

SEQ ID NO: 1145 - RNA, 20 nt, Artificial Sequence
  Targeting Domain
ggugugccagcuggcgguau

SEQ ID NO: 1146 - RNA, 20 nt, Artificial Sequence
  Targeting Domain
ggggugaucuuguugaaggu

SEQ ID NO: 1147 - RNA, 20 nt, Artificial Sequence
  Targeting Domain
gaaggcgaacucagccaggu

SEQ ID NO: 1148 - RNA, 20 nt, Artificial Sequence
  Targeting Domain
agguugggugauccugauca

SEQ ID NO: 1149 - RNA, 20 nt, Artificial Sequence
  Targeting Domain
acucacgaugaaauccugga

SEQ ID NO: 1150 - RNA, 20 nt, Artificial Sequence
  Targeting Domain
ccggaggcucagauccauga

SEQ ID NO: 1151 - RNA, 20 nt, Artificial Sequence
  Targeting Domain
cagcuggcgguauaggcuga

SEQ ID NO: 1152 - RNA, 20 nt, Artificial Sequence
  Targeting Domain
caacaagaucacccccaacc

SEQ ID NO: 1153 - RNA, 20 nt, Artificial Sequence
  Targeting Domain
ugaggguacggaggaguucc

SEQ ID NO: 1154 - RNA, 20 nt, Artificial Sequence
  Targeting Domain
cuucagccuauaccgccagc

SEQ ID NO: 1155 - RNA, 20 nt, Artificial Sequence
  Targeting Domain
uguuggacuggugugccagc

SEQ ID NO: 1156 - RNA, 20 nt, Artificial Sequence
  Targeting Domain
uuucaaccucacggagauuc

SEQ ID NO: 1157 - RNA, 20 nt, Artificial Sequence
  Targeting Domain
caauggccuguuccucagcg

SEQ ID NO: 1158 - RNA, 20 nt, Artificial Sequence
  Targeting Domain
caaugccgucuucugucucg

SEQ ID NO: 1159 - RNA, 20 nt, Artificial Sequence
  Targeting Domain
caaccucacggagauuccgg

SEQ ID NO: 1160 - RNA, 20 nt, Artificial Sequence
  Targeting Domain
cuagcuucaggcccucgcug

SEQ ID NO: 1161 - RNA, 20 nt, Artificial Sequence
  Targeting Domain
augccgucuucugucucgug

SEQ ID NO: 1162 - RNA, 20 nt, Artificial Sequence
  Targeting Domain
aggcgaacucagccagguug

SEQ ID NO: 1163 - RNA, 20 nt, Artificial Sequence
  Targeting Domain
uucaucgugagugucagccu

SEQ ID NO: 1164 - RNA, 20 nt, Artificial Sequence
  Targeting Domain
ugggugauccugaucauggu

SEQ ID NO: 1165 - RNA, 20 nt, Artificial Sequence
  Targeting Domain
aaggcgaacucagccagguu

SEQ ID NO: 1166 - RNA, 17 nt, Artificial Sequence
  Targeting Domain
gcucucccuggggacca

SEQ ID NO: 1167 - RNA, 17 nt, Artificial Sequence
  Targeting Domain
gucagccuuggucccca

SEQ ID NO: 1168 - RNA, 17 nt, Artificial Sequence
  Targeting Domain
guggagaaggguacuca

SEQ ID NO: 1169 - RNA, 17 nt, Artificial Sequence
  Targeting Domain
guuccuggaagccuuca

SEQ ID NO: 1170 - RNA, 17 nt, Artificial Sequence
  Targeting Domain
guccugcaagacagaga

SEQ ID NO: 1171 - RNA, 17 nt, Artificial Sequence
  Targeting Domain
ggccuguuccucagcga

SEQ ID NO: 1172 - RNA, 17 nt, Artificial Sequence
  Targeting Domain
gaggcucagauccauga

SEQ ID NO: 1173 - RNA, 17 nt, Artificial Sequence
  Targeting Domain
gcugucuggcugguuga

SEQ ID NO: 1174 - RNA, 17 nt, Artificial Sequence
  Targeting Domain
gggggugaucuuguuga

SEQ ID NO: 1175 - RNA, 17 nt, Artificial Sequence
  Targeting Domain
ggcccucgcugaggaac

SEQ ID NO: 1176 - RNA, 17 nt, Artificial Sequence
  Targeting Domain
gcuguagcgaugcucac

SEQ ID NO: 1177 - RNA, 17 nt, Artificial Sequence
  Targeting Domain
ggcaggccugugcugcc

SEQ ID NO: 1178 - RNA, 17 nt, Artificial Sequence
  Targeting Domain
gauccaugaaggcuucc

SEQ ID NO: 1179 - RNA, 17 nt, Artificial Sequence
  Targeting Domain
ggguacggaggaguucc

SEQ ID NO: 1180 - RNA, 17 nt, Artificial Sequence
  Targeting Domain
ggcauccuccugcuggc

SEQ ID NO: 1181 - RNA, 17 nt, Artificial Sequence
  Targeting Domain
ggagcuggcugucuggc

SEQ ID NO: 1182 - RNA, 17 nt, Artificial Sequence
  Targeting Domain
guggggcauccuccugc

SEQ ID NO: 1183 - RNA, 17 nt, Artificial Sequence
  Targeting Domain
gaggaacaggccauugc

SEQ ID NO: 1184 - RNA, 17 nt, Artificial Sequence
  Targeting Domain
gggauguaucugucuuc

SEQ ID NO: 1185 - RNA, 17 nt, Artificial Sequence
  Targeting Domain
gcugguugaggguacgg

SEQ ID NO: 1186 - RNA, 17 nt, Artificial Sequence
  Targeting Domain
gaacaggccauugccgg

SEQ ID NO: 1187 - RNA, 17 nt, Artificial Sequence
  Targeting Domain
gcaagacagagaugggg

SEQ ID NO: 1188 - RNA, 17 nt, Artificial Sequence
  Targeting Domain
ggugauccugaucaugg

SEQ ID NO: 1189 - RNA, 17 nt, Artificial Sequence
  Targeting Domain
gaacucagccagguugg

SEQ ID NO: 1190 - RNA, 17 nt, Artificial Sequence
  Targeting Domain
gcuucaggcccucgcug

SEQ ID NO: 1191 - RNA, 17 nt, Artificial Sequence
  Targeting Domain
ggcugucuggcugguug

SEQ ID NO: 1192 - RNA, 17 nt, Artificial Sequence
  Targeting Domain
gugccagcuggcgguau

SEQ ID NO: 1193 - RNA, 17 nt, Artificial Sequence
  Targeting Domain
ggauguaucugucuucu

SEQ ID NO: 1194 - RNA, 17 nt, Artificial Sequence
  Targeting Domain
gccgucuucugucucgu

SEQ ID NO: 1195 - RNA, 17 nt, Artificial Sequence
  Targeting Domain
gugaucuuguugaaggu

SEQ ID NO: 1196 - RNA, 17 nt, Artificial Sequence
  Targeting Domain
ggcgaacucagccaggu

SEQ ID NO: 1197 - RNA, 17 nt, Artificial Sequence
  Targeting Domain
gugauccugaucauggu

SEQ ID NO: 1198 - RNA, 17 nt, Artificial Sequence
  Targeting Domain
gaagauauuggugcugu

SEQ ID NO: 1199 - RNA, 17 nt, Artificial Sequence
  Targeting Domain
gccuucacugucaacuu

SEQ ID NO: 1200 - RNA, 17 nt, Artificial Sequence
  Targeting Domain
gcgaacucagccagguu

SEQ ID NO: 1201 - RNA, 17 nt, Artificial Sequence
  Targeting Domain
gcuaguggauaaguuuu

SEQ ID NO: 1202 - RNA, 20 nt, Artificial Sequence
  Targeting Domain
gugaauuacaucuucuuuaa

SEQ ID NO: 1203 - RNA, 20 nt, Artificial Sequence
  Targeting Domain
gauccucagccagggagaca

SEQ ID NO: 1204 - RNA, 20 nt, Artificial Sequence
  Targeting Domain
gggccugaauuucaaccuca

SEQ ID NO: 1205 - RNA, 20 nt, Artificial Sequence
  Targeting Domain
gaaaauuguggauuugguca

SEQ ID NO: 1206 - RNA, 20 nt, Artificial Sequence
  Targeting Domain
ggaguuccuggaagccuuca

SEQ ID NO: 1207 - RNA, 20 nt, Artificial Sequence
  Targeting Domain
guccccgaaguugacaguga

SEQ ID NO: 1208 - RNA, 20 nt, Artificial Sequence
  Targeting Domain
guugggggugaucuuguuga

SEQ ID NO: 1209 - RNA, 20 nt, Artificial Sequence
  Targeting Domain
ggauccucagccagggagac

SEQ ID NO: 1210 - RNA, 20 nt, Artificial Sequence
  Targeting Domain
gagugucagccuuggucccc

SEQ ID NO: 1211 - RNA, 20 nt, Artificial Sequence
  Targeting Domain
ggcugaaggcgaacucagcc

SEQ ID NO: 1212 - RNA, 20 nt, Artificial Sequence
  Targeting Domain
gcuggcaggccugugcugcc

SEQ ID NO: 1213 - RNA, 20 nt, Artificial Sequence
  Targeting Domain
gguugaaauucaggcccucc

SEQ ID NO: 1214 - RNA, 20 nt, Artificial Sequence
  Targeting Domain
ggcagcacaggccugccagc

SEQ ID NO: 1215 - RNA, 20 nt, Artificial Sequence
  Targeting Domain
ggccauugccgguggucagc

SEQ ID NO: 1216 - RNA, 20 nt, Artificial Sequence
  Targeting Domain
gcuggagcuggcugucuggc

SEQ ID NO: 1217 - RNA, 20 nt, Artificial Sequence
  Targeting Domain
gcugaggaacaggccauugc

SEQ ID NO: 1218 - RNA, 20 nt, Artificial Sequence
  Targeting Domain
gucagcuggagcuggcuguc

SEQ ID NO: 1219 - RNA, 20 nt, Artificial Sequence
  Targeting Domain
ggugggauguaucugucuuc

SEQ ID NO: 1220 - RNA, 20 nt, Artificial Sequence
  Targeting Domain
guccugcaagacagagaugg

SEQ ID NO: 1221 - RNA, 20 nt, Artificial Sequence
  Targeting Domain
ggcgaacucagccagguugg

SEQ ID NO: 1222 - RNA, 20 nt, Artificial Sequence
  Targeting Domain
gcuaguggauaaguuuuugg

SEQ ID NO: 1223 - RNA, 20 nt, Artificial Sequence
  Targeting Domain
ggucccugucucccuggcug

SEQ ID NO: 1224 - RNA, 20 nt, Artificial Sequence
  Targeting Domain
ggguacucaagggaaaauug

SEQ ID NO: 1225 - RNA, 20 nt, Artificial Sequence
  Targeting Domain
gcuggcugucuggcugguug

SEQ ID NO: 1226 - RNA, 20 nt, Artificial Sequence
  Targeting Domain
gccuuugcaaugcucucccu

SEQ ID NO: 1227 - RNA, 20 nt, Artificial Sequence
  Targeting Domain
gugggauguaucugucuucu

SEQ ID NO: 1228 - RNA, 20 nt, Artificial Sequence
  Targeting Domain
guaaucguugaucuguuucu

SEQ ID NO: 1229 - RNA, 20 nt, Artificial Sequence
  Targeting Domain
gaagaagauauuggugcugu

SEQ ID NO: 1230 - RNA, 20 nt, Artificial Sequence
  Targeting Domain
gaagccuucacugucaacuu

SEQ ID NO: 1231 - RNA, 20 nt, Artificial Sequence
  Targeting Domain
gaucuguuucuuggccucuu

SEQ ID NO: 1232 - RNA, 20 nt, Artificial Sequence
  Targeting Domain
gggugaucuuguugaagguu

SEQ ID NO: 1233 - RNA, 20 nt, Artificial Sequence
  Targeting Domain
gaagcuaguggauaaguuuu

SEQ ID NO: 1234 - RNA, 17 nt, Artificial Sequence
  Targeting Domain
cagcugaccaccggcaa

SEQ ID NO: 1235 - RNA, 17 nt, Artificial Sequence
  Targeting Domain
cagggagagcauugcaa

SEQ ID NO: 1236 - RNA, 17 nt, Artificial Sequence
  Targeting Domain
uggagaaggguacucaa

SEQ ID NO: 1237 - RNA, 17 nt, Artificial Sequence
  Targeting Domain
aacgauuacguggagaa

SEQ ID NO: 1238 - RNA, 17 nt, Artificial Sequence
  Targeting Domain
aauuacaucuucuuuaa

SEQ ID NO: 1239 - RNA, 17 nt, Artificial Sequence
  Targeting Domain
ccucagccagggagaca

SEQ ID NO: 1240 - RNA, 17 nt, Artificial Sequence
  Targeting Domain
cuggcugaggaucccca

SEQ ID NO: 1241 - RNA, 17 nt, Artificial Sequence
  Targeting Domain
cuggggauccucagcca

SEQ ID NO: 1242 - RNA, 17 nt, Artificial Sequence
  Targeting Domain
uugggugauccugauca

SEQ ID NO: 1243 - RNA, 17 nt, Artificial Sequence
  Targeting Domain
ccugaauuucaaccuca

SEQ ID NO: 1244 - RNA, 17 nt, Artificial Sequence
  Targeting Domain
aauuguggauuugguca

SEQ ID NO: 1245 - RNA, 17 nt, Artificial Sequence
  Targeting Domain
ccccacgagacagaaga

SEQ ID NO: 1246 - RNA, 17 nt, Artificial Sequence
  Targeting Domain
caacgauuacguggaga

SEQ ID NO: 1247 - RNA, 17 nt, Artificial Sequence
  Targeting Domain
cacgaugaaauccugga

SEQ ID NO: 1248 - RNA, 17 nt, Artificial Sequence
  Targeting Domain
cuggcgguauaggcuga

SEQ ID NO: 1249 - RNA, 17 nt, Artificial Sequence
  Targeting Domain
cccgaaguugacaguga

SEQ ID NO: 1250 - RNA, 17 nt, Artificial Sequence
  Targeting Domain
caucuucuuuaaaggua

SEQ ID NO: 1251 - RNA, 17 nt, Artificial Sequence
  Targeting Domain
cuggcugguugagggua

SEQ ID NO: 1252 - RNA, 17 nt, Artificial Sequence
  Targeting Domain
cagcuccagcugaccac

SEQ ID NO: 1253 - RNA, 17 nt, Artificial Sequence
  Targeting Domain
cagggaccaggcagcac

SEQ ID NO: 1254 - RNA, 17 nt, Artificial Sequence
  Targeting Domain
uccucagccagggagac

SEQ ID NO: 1255 - RNA, 17 nt, Artificial Sequence
  Targeting Domain
uauuggugcuguuggac

SEQ ID NO: 1256 - RNA, 17 nt, Artificial Sequence
  Targeting Domain
caagaucacccccaacc

SEQ ID NO: 1257 - RNA, 17 nt, Artificial Sequence
  Targeting Domain
ccagggagacagggacc

SEQ ID NO: 1258 - RNA, 17 nt, Artificial Sequence
  Targeting Domain
ccuggcugaggaucccc

SEQ ID NO: 1259 - RNA, 17 nt, Artificial Sequence
  Targeting Domain
ugucagccuuggucccc

SEQ ID NO: 1260 - RNA, 17 nt, Artificial Sequence
  Targeting Domain
ucugggcagcaucuccc

SEQ ID NO: 1261 - RNA, 17 nt, Artificial Sequence
  Targeting Domain
cuuugcaaugcucuccc

SEQ ID NO: 1262 - RNA, 17 nt, Artificial Sequence
  Targeting Domain
ccuggucccugucuccc

SEQ ID NO: 1263 - RNA, 17 nt, Artificial Sequence
  Targeting Domain
ugaaggcgaacucagcc

SEQ ID NO: 1264 - RNA, 17 nt, Artificial Sequence
  Targeting Domain
ccuggggauccucagcc

SEQ ID NO: 1265 - RNA, 17 nt, Artificial Sequence
  Targeting Domain
acagagaugggggggcc

SEQ ID NO: 1266 - RNA, 17 nt, Artificial Sequence
  Targeting Domain
cacucacgaugaaaucc

SEQ ID NO: 1267 - RNA, 17 nt, Artificial Sequence
  Targeting Domain
ugaaauucaggcccucc

SEQ ID NO: 1268 - RNA, 17 nt, Artificial Sequence
  Targeting Domain
cagccuauaccgccagc

SEQ ID NO: 1269 - RNA, 17 nt, Artificial Sequence
  Targeting Domain
agcacaggccugccagc

SEQ ID NO: 1270 - RNA, 17 nt, Artificial Sequence
  Targeting Domain
uggacuggugugccagc

SEQ ID NO: 1271 - RNA, 17 nt, Artificial Sequence
  Targeting Domain
cauugccgguggucagc

SEQ ID NO: 1272 - RNA, 17 nt, Artificial Sequence
  Targeting Domain
cgguggucagcuggagc

SEQ ID NO: 1273 - RNA, 17 nt, Artificial Sequence
  Targeting Domain
ccccaucucugucuugc

SEQ ID NO: 1274 - RNA, 17 nt, Artificial Sequence
  Targeting Domain
uacaucccaccaugauc

SEQ ID NO: 1275 - RNA, 17 nt, Artificial Sequence
  Targeting Domain
ucauggaucugagccuc

SEQ ID NO: 1276 - RNA, 17 nt, Artificial Sequence
  Targeting Domain
agacacaguuuuugcuc

SEQ ID NO: 1277 - RNA, 17 nt, Artificial Sequence
  Targeting Domain
agcuggagcuggcuguc

SEQ ID NO: 1278 - RNA, 17 nt, Artificial Sequence
  Targeting Domain
ccgugagguugaaauuc

SEQ ID NO: 1279 - RNA, 17 nt, Artificial Sequence
  Targeting Domain
caaccucacggagauuc

SEQ ID NO: 1280 - RNA, 17 nt, Artificial Sequence
  Targeting Domain
ccuucacugucaacuuc

SEQ ID NO: 1281 - RNA, 17 nt, Artificial Sequence
  Targeting Domain
acuuauccacuagcuuc

SEQ ID NO: 1282 - RNA, 17 nt, Artificial Sequence
  Targeting Domain
cuucggggacaccgaag

SEQ ID NO: 1283 - RNA, 17 nt, Artificial Sequence
  Targeting Domain
cagugaaggcuucugag

SEQ ID NO: 1284 - RNA, 17 nt, Artificial Sequence
  Targeting Domain
cgagggccugaagcuag

SEQ ID NO: 1285 - RNA, 17 nt, Artificial Sequence
  Targeting Domain
acagaucaacgauuacg

SEQ ID NO: 1286 - RNA, 17 nt, Artificial Sequence
  Targeting Domain
uggccuguuccucagcg

SEQ ID NO: 1287 - RNA, 17 nt, Artificial Sequence
  Targeting Domain
ugccgucuucugucucg

SEQ ID NO: 1288 - RNA, 17 nt, Artificial Sequence
  Targeting Domain
cuucacugucaacuucg

SEQ ID NO: 1289 - RNA, 17 nt, Artificial Sequence
  Targeting Domain
acaggccugccagcagg

SEQ ID NO: 1290 - RNA, 17 nt, Artificial Sequence
  Targeting Domain
ccucacggagauuccgg

SEQ ID NO: 1291 - RNA, 17 nt, Artificial Sequence
  Targeting Domain
ugcaagacagagauggg

SEQ ID NO: 1292 - RNA, 17 nt, Artificial Sequence
  Targeting Domain
cugcaagacagagaugg

SEQ ID NO: 1293 - RNA, 17 nt, Artificial Sequence
  Targeting Domain
ucacgaugaaauccugg

SEQ ID NO: 1294 - RNA, 17 nt, Artificial Sequence
  Targeting Domain
acuggugugccagcugg

SEQ ID NO: 1295 - RNA, 17 nt, Artificial Sequence
  Targeting Domain
aguggauaaguuuuugg

SEQ ID NO: 1296 - RNA, 17 nt, Artificial Sequence
  Targeting Domain
ccugcaagacagagaug

SEQ ID NO: 1297 - RNA, 17 nt, Artificial Sequence
  Targeting Domain
uguagcgaugcucacug

SEQ ID NO: 1298 - RNA, 17 nt, Artificial Sequence
  Targeting Domain
ugggcagcaucucccug

SEQ ID NO: 1299 - RNA, 17 nt, Artificial Sequence
  Targeting Domain
uugcaaugcucucccug

SEQ ID NO: 1300 - RNA, 17 nt, Artificial Sequence
  Targeting Domain
cccugucucccuggcug

SEQ ID NO: 1301 - RNA, 17 nt, Artificial Sequence
  Targeting Domain
ccuccggaaucuccgug

SEQ ID NO: 1302 - RNA, 17 nt, Artificial Sequence
  Targeting Domain
ccgucuucugucucgug

SEQ ID NO: 1303 - RNA, 17 nt, Artificial Sequence
  Targeting Domain
uacucaagggaaaauug

SEQ ID NO: 1304 - RNA, 17 nt, Artificial Sequence
  Targeting Domain
cgaacucagccagguug

SEQ ID NO: 1305 - RNA, 17 nt, Artificial Sequence
  Targeting Domain
uccugcaagacagagau

SEQ ID NO: 1306 - RNA, 17 nt, Artificial Sequence
  Targeting Domain
uggggagaagaagauau

SEQ ID NO: 1307 - RNA, 17 nt, Artificial Sequence
  Targeting Domain
cuguagcgaugcucacu

SEQ ID NO: 1308 - RNA, 17 nt, Artificial Sequence
  Targeting Domain
cugggcagcaucucccu

SEQ ID NO: 1309 - RNA, 17 nt, Artificial Sequence
  Targeting Domain
uuugcaaugcucucccu

SEQ ID NO: 1310 - RNA, 17 nt, Artificial Sequence
  Targeting Domain
aucgugagugucagccu

SEQ ID NO: 1311 - RNA, 17 nt, Artificial Sequence
  Targeting Domain
aucguugaucuguuucu

SEQ ID NO: 1312 - RNA, 17 nt, Artificial Sequence
  Targeting Domain
agggaaaauuguggauu

SEQ ID NO: 1313 - RNA, 17 nt, Artificial Sequence
  Targeting Domain
cuguuucuuggccucuu

SEQ ID NO: 1314 - RNA, 17 nt, Artificial Sequence
  Targeting Domain
ugaucuuguugaagguu

SEQ ID NO: 1315 - RNA, 20 nt, Artificial Sequence
  Targeting Domain
cuccagcugaccaccggcaa

SEQ ID NO: 1316 - RNA, 20 nt, Artificial Sequence
  Targeting Domain
ccccagggagagcauugcaa

SEQ ID NO: 1317 - RNA, 20 nt, Artificial Sequence
  Targeting Domain
acguggagaaggguacucaa

SEQ ID NO: 1318 - RNA, 20 nt, Artificial Sequence
  Targeting Domain
aucaacgauuacguggagaa

SEQ ID NO: 1319 - RNA, 20 nt, Artificial Sequence
  Targeting Domain
aaugcucucccuggggacca

SEQ ID NO: 1320 - RNA, 20 nt, Artificial Sequence
  Targeting Domain
ucccuggcugaggaucccca

SEQ ID NO: 1321 - RNA, 20 nt, Artificial Sequence
  Targeting Domain
agugucagccuuggucccca

SEQ ID NO: 1322 - RNA, 20 nt, Artificial Sequence
  Targeting Domain
ucccuggggauccucagcca

SEQ ID NO: 1323 - RNA, 20 nt, Artificial Sequence
  Targeting Domain
uacguggagaaggguacuca

SEQ ID NO: 1324 - RNA, 20 nt, Artificial Sequence
  Targeting Domain
augccccacgagacagaaga

SEQ ID NO: 1325 - RNA, 20 nt, Artificial Sequence
  Targeting Domain
auuguccugcaagacagaga

SEQ ID NO: 1326 - RNA, 20 nt, Artificial Sequence
  Targeting Domain
aauggccuguuccucagcga

SEQ ID NO: 1327 - RNA, 20 nt, Artificial Sequence
  Targeting Domain
cuggcugucuggcugguuga

SEQ ID NO: 1328 - RNA, 20 nt, Artificial Sequence
  Targeting Domain
uuacaucuucuuuaaaggua

SEQ ID NO: 1329 - RNA, 20 nt, Artificial Sequence
  Targeting Domain
ugucuggcugguugagggua

SEQ ID NO: 1330 - RNA, 20 nt, Artificial Sequence
  Targeting Domain
ucaggcccucgcugaggaac

SEQ ID NO: 1331 - RNA, 20 nt, Artificial Sequence
  Targeting Domain
agccagcuccagcugaccac

SEQ ID NO: 1332 - RNA, 20 nt, Artificial Sequence
  Targeting Domain
agacagggaccaggcagcac

SEQ ID NO: 1333 - RNA, 20 nt, Artificial Sequence
  Targeting Domain
aaggcuguagcgaugcucac

SEQ ID NO: 1334 - RNA, 20 nt, Artificial Sequence
  Targeting Domain
agauauuggugcuguuggac

SEQ ID NO: 1335 - RNA, 20 nt, Artificial Sequence
  Targeting Domain
cagccagggagacagggacc

SEQ ID NO: 1336 - RNA, 20 nt, Artificial Sequence
  Targeting Domain
cucccuggcugaggaucccc

SEQ ID NO: 1337 - RNA, 20 nt, Artificial Sequence
  Targeting Domain
ucuucugggcagcaucuccc

SEQ ID NO: 1338 - RNA, 20 nt, Artificial Sequence
  Targeting Domain
agccuuugcaaugcucuccc

SEQ ID NO: 1339 - RNA, 20 nt, Artificial Sequence
  Targeting Domain
cugccuggucccugucuccc

SEQ ID NO: 1340 - RNA, 20 nt, Artificial Sequence
  Targeting Domain
cucccuggggauccucagcc

SEQ ID NO: 1341 - RNA, 20 nt, Artificial Sequence
  Targeting Domain
aagacagagaugggggggcc

SEQ ID NO: 1342 - RNA, 20 nt, Artificial Sequence
  Targeting Domain
ugacacucacgaugaaaucc

SEQ ID NO: 1343 - RNA, 20 nt, Artificial Sequence
  Targeting Domain
ucagauccaugaaggcuucc

SEQ ID NO: 1344 - RNA, 20 nt, Artificial Sequence
  Targeting Domain
ugccgguggucagcuggagc

SEQ ID NO: 1345 - RNA, 20 nt, Artificial Sequence
  Targeting Domain
uggggcauccuccugcuggc

SEQ ID NO: 1346 - RNA, 20 nt, Artificial Sequence
  Targeting Domain
cucguggggcauccuccugc

SEQ ID NO: 1347 - RNA, 20 nt, Artificial Sequence
  Targeting Domain
cccccccaucucugucuugc

SEQ ID NO: 1348 - RNA, 20 nt, Artificial Sequence
  Targeting Domain
agauacaucccaccaugauc

SEQ ID NO: 1349 - RNA, 20 nt, Artificial Sequence
  Targeting Domain
ccuucauggaucugagccuc

SEQ ID NO: 1350 - RNA, 20 nt, Artificial Sequence
  Targeting Domain
cagagacacaguuuuugcuc

SEQ ID NO: 1351 - RNA, 20 nt, Artificial Sequence
  Targeting Domain
ucuccgugagguugaaauuc

SEQ ID NO: 1352 - RNA, 20 nt, Artificial Sequence
  Targeting Domain
aagccuucacugucaacuuc

SEQ ID NO: 1353 - RNA, 20 nt, Artificial Sequence
  Targeting Domain
aaaacuuauccacuagcuuc

SEQ ID NO: 1354 - RNA, 20 nt, Artificial Sequence
  Targeting Domain
caacuucggggacaccgaag

SEQ ID NO: 1355 - RNA, 20 nt, Artificial Sequence
  Targeting Domain
ugacagugaaggcuucugag

SEQ ID NO: 1356 - RNA, 20 nt, Artificial Sequence
  Targeting Domain
cagcgagggccugaagcuag

SEQ ID NO: 1357 - RNA, 20 nt, Artificial Sequence
  Targeting Domain
agccuucacugucaacuucg

SEQ ID NO: 1358 - RNA, 20 nt, Artificial Sequence
  Targeting Domain
agcacaggccugccagcagg

SEQ ID NO: 1359 - RNA, 20 nt, Artificial Sequence
  Targeting Domain
cuggcugguugaggguacgg

SEQ ID NO: 1360 - RNA, 20 nt, Artificial Sequence
  Targeting Domain
ccugcaagacagagaugggg

SEQ ID NO: 1361 - RNA, 20 nt, Artificial Sequence
  Targeting Domain
uccugcaagacagagauggg

SEQ ID NO: 1362 - RNA, 20 nt, Artificial Sequence
  Targeting Domain
uugggugauccugaucaugg

SEQ ID NO: 1363 - RNA, 20 nt, Artificial Sequence
  Targeting Domain
cacucacgaugaaauccugg

SEQ ID NO: 1364 - RNA, 20 nt, Artificial Sequence
  Targeting Domain
uggacuggugugccagcugg

SEQ ID NO: 1365 - RNA, 20 nt, Artificial Sequence
  Targeting Domain
uguccugcaagacagagaug

SEQ ID NO: 1366 - RNA, 20 nt, Artificial Sequence
  Targeting Domain
uucugggcagcaucucccug

SEQ ID NO: 1367 - RNA, 20 nt, Artificial Sequence
  Targeting Domain
ccuuugcaaugcucucccug

SEQ ID NO: 1368 - RNA, 20 nt, Artificial Sequence
  Targeting Domain
uuguccugcaagacagagau

SEQ ID NO: 1369 - RNA, 20 nt, Artificial Sequence
  Targeting Domain
cacuggggagaagaagauau

SEQ ID NO: 1370 - RNA, 20 nt, Artificial Sequence
  Targeting Domain
aggcuguagcgaugcucacu

SEQ ID NO: 1371 - RNA, 20 nt, Artificial Sequence
  Targeting Domain
cuucugggcagcaucucccu

SEQ ID NO: 1372 - RNA, 20 nt, Artificial Sequence
  Targeting Domain
aaugccgucuucugucucgu

SEQ ID NO: 1373 - RNA, 20 nt, Artificial Sequence
  Targeting Domain
ucaagggaaaauuguggauu

SEQ ID NO: 1374 - RNA, 21 nt, Artificial Sequence
  Targeting Domain
gaccaaauccacaauuuuccc

SEQ ID NO: 1375 - RNA, 21 nt, Artificial Sequence
  Targeting Domain
gagguugaaauucaggcccuc

SEQ ID NO: 1376 - RNA, 23 nt, Artificial Sequence
  Targeting Domain
gugagguugaaauucaggcccuc

SEQ ID NO: 1377 - RNA, 21 nt, Artificial Sequence
  Targeting Domain
gccuucauggaucugagccuc

SEQ ID NO: 1378 - RNA, 24 nt, Artificial Sequence
  Targeting Domain
gaagccuucauggaucugagccuc

SEQ ID NO: 1379 - RNA, 21 nt, Artificial Sequence
  Targeting Domain
gaggaguuccuggaagccuuc

SEQ ID NO: 1380 - RNA, 22 nt, Artificial Sequence
  Targeting Domain
ggaggaguuccuggaagccuuc

SEQ ID NO: 1381 - RNA, 18 nt, Artificial Sequence
  Targeting Domain
gggugaucuuguugaagg

SEQ ID NO: 1382 - RNA, 19 nt, Artificial Sequence
  Targeting Domain
ggggugaucuuguugaagg

SEQ ID NO: 1383 - RNA, 20 nt, Artificial Sequence
  Targeting Domain
gggggugaucuuguugaagg

SEQ ID NO: 1384 - RNA, 23 nt, Artificial Sequence
  Targeting Domain
guugggggugaucuuguugaagg

SEQ ID NO: 1385 - RNA, 24 nt, Artificial Sequence
  Targeting Domain
gguugggggugaucuuguugaagg

SEQ ID NO: 1386 - RNA, 18 nt, Artificial Sequence
  Targeting Domain
ggcugguugaggguacgg

SEQ ID NO: 1387 - RNA, 22 nt, Artificial Sequence
  Targeting Domain
gucuggcugguugaggguacgg

SEQ ID NO: 1388 - RNA, 18 nt, Artificial Sequence
  Targeting Domain
gggugauccugaucaugg

SEQ ID NO: 1389 - RNA, 21 nt, Artificial Sequence
  Targeting Domain
guugggugauccugaucaugg

SEQ ID NO: 1390 - RNA, 22 nt, Artificial Sequence
  Targeting Domain
gguugggugauccugaucaugg

SEQ ID NO: 1391 - RNA, 22 nt, Artificial Sequence
  Targeting Domain
gucuucugggcagcaucucccu

SEQ ID NO: 1392 - RNA, 18 nt, Artificial Sequence
  Targeting Domain
ggcgaacucagccagguu

SEQ ID NO: 1393 - RNA, 21 nt, Artificial Sequence
  Targeting Domain
gaaggcgaacucagccagguu

SEQ ID NO: 1394 - RNA, 24 nt, Artificial Sequence
  Targeting Domain
gcugaaggcgaacucagccagguu

SEQ ID NO: 1395 - RNA, 21 nt, Artificial Sequence
  Targeting Domain
gagcuggcugucuggcugguu

SEQ ID NO: 1396 - RNA, 22 nt, Artificial Sequence
  Targeting Domain
ggagcuggcugucuggcugguu

SEQ ID NO: 1397 - RNA, 19 nt, Artificial Sequence
  Targeting Domain
gaucaacgauuacguggag

SEQ ID NO: 1398 - RNA, 24 nt, Artificial Sequence
  Targeting Domain
gacagagacacaguuuuugcucug

SEQ ID NO: 1399 - RNA, 22 nt, Artificial Sequence
  Targeting Domain
gaagcuaguggauaaguuuuug

SEQ ID NO: 1400 - RNA, 18 nt, Artificial Sequence
  Targeting Domain
gauacaucccaccaugau

SEQ ID NO: 1401 - RNA, 22 nt, Artificial Sequence
  Targeting Domain
gacagauacaucccaccaugau

SEQ ID NO: 1402 - RNA, 23 nt, Artificial Sequence
  Targeting Domain
gccuggucccugucucccuggcu

SEQ ID NO: 1403 - RNA, 22 nt, Artificial Sequence
  Targeting Domain
gaaggguacucaagggaaaauu

SEQ ID NO: 1404 - RNA, 24 nt, Artificial Sequence
  Targeting Domain
gagaaggguacucaagggaaaauu

SEQ ID NO: 1405 - RNA, 22 nt, Artificial Sequence
  Targeting Domain
ugaccaaauccacaauuuuccc

SEQ ID NO: 1406 - RNA, 23 nt, Artificial Sequence
  Targeting Domain
uugaccaaauccacaauuuuccc

SEQ ID NO: 1407 - RNA, 24 nt, Artificial Sequence
  Targeting Domain
cuugaccaaauccacaauuuuccc

SEQ ID NO: 1408 - RNA, 21 nt, Artificial Sequence
  Targeting Domain
caggcccuccaggauuucauc

SEQ ID NO: 1409 - RNA, 22 nt, Artificial Sequence
  Targeting Domain
ucaggcccuccaggauuucauc

SEQ ID NO: 1410 - RNA, 23 nt, Artificial Sequence
  Targeting Domain
uucaggcccuccaggauuucauc

SEQ ID NO: 1411 - RNA, 24 nt, Artificial Sequence
  Targeting Domain
auucaggcccuccaggauuucauc

SEQ ID NO: 1412 - RNA, 22 nt, Artificial Sequence
  Targeting Domain
ugagguugaaauucaggcccuc

SEQ ID NO: 1413 - RNA, 24 nt, Artificial Sequence
  Targeting Domain
cgugagguugaaauucaggcccuc

SEQ ID NO: 1414 - RNA, 18 nt, Artificial Sequence
  Targeting Domain
uucauggaucugagccuc

SEQ ID NO: 1415 - RNA, 19 nt, Artificial Sequence
  Targeting Domain
cuucauggaucugagccuc

SEQ ID NO: 1416 - RNA, 22 nt, Artificial Sequence
  Targeting Domain
agccuucauggaucugagccuc

SEQ ID NO: 1417 - RNA, 23 nt, Artificial Sequence
  Targeting Domain
aagccuucauggaucugagccuc

SEQ ID NO: 1418 - RNA, 23 nt, Artificial Sequence
  Targeting Domain
cggaggaguuccuggaagccuuc

SEQ ID NO: 1419 - RNA, 24 nt, Artificial Sequence
  Targeting Domain
acggaggaguuccuggaagccuuc

SEQ ID NO: 1420 - RNA, 21 nt, Artificial Sequence
  Targeting Domain
ugggggugaucuuguugaagg

SEQ ID NO: 1421 - RNA, 22 nt, Artificial Sequence
  Targeting Domain
uugggggugaucuuguugaagg

SEQ ID NO: 1422 - RNA, 19 nt, Artificial Sequence
  Targeting Domain
uggcugguugaggguacgg

SEQ ID NO: 1423 - RNA, 21 nt, Artificial Sequence
  Targeting Domain
ucuggcugguugaggguacgg

SEQ ID NO: 1424 - RNA, 23 nt, Artificial Sequence
  Targeting Domain
ugucuggcugguugaggguacgg

SEQ ID NO: 1425 - RNA, 24 nt, Artificial Sequence
  Targeting Domain
cugucuggcugguugaggguacgg

SEQ ID NO: 1426 - RNA, 19 nt, Artificial Sequence
  Targeting Domain
ugggugauccugaucaugg

SEQ ID NO: 1427 - RNA, 23 nt, Artificial Sequence
  Targeting Domain
agguugggugauccugaucaugg

SEQ ID NO: 1428 - RNA, 24 nt, Artificial Sequence
  Targeting Domain
aagguugggugauccugaucaugg

SEQ ID NO: 1429 - RNA, 21 nt, Artificial Sequence
  Targeting Domain
ucuucugggcagcaucucccu

SEQ ID NO: 1430 - RNA, 23 nt, Artificial Sequence
  Targeting Domain
ugucuucugggcagcaucucccu

SEQ ID NO: 1431 - RNA, 24 nt, Artificial Sequence
  Targeting Domain
cugucuucugggcagcaucucccu

SEQ ID NO: 1432 - RNA, 21 nt, Artificial Sequence
  Targeting Domain
cgaaguugacagugaaggcuu

SEQ ID NO: 1433 - RNA, 22 nt, Artificial Sequence
  Targeting Domain
ccgaaguugacagugaaggcuu

SEQ ID NO: 1434 - RNA, 23 nt, Artificial Sequence
  Targeting Domain
cccgaaguugacagugaaggcuu

SEQ ID NO: 1435 - RNA, 24 nt, Artificial Sequence
  Targeting Domain
ccccgaaguugacagugaaggcuu

SEQ ID NO: 1436 - RNA, 19 nt, Artificial Sequence
  Targeting Domain
aggcgaacucagccagguu

SEQ ID NO: 1437 - RNA, 22 nt, Artificial Sequence
  Targeting Domain
ugaaggcgaacucagccagguu

SEQ ID NO: 1438 - RNA, 23 nt, Artificial Sequence
  Targeting Domain
cugaaggcgaacucagccagguu

SEQ ID NO: 1439 - RNA, 23 nt, Artificial Sequence
  Targeting Domain
uggagcuggcugucuggcugguu

SEQ ID NO: 1440 - RNA, 24 nt, Artificial Sequence
  Targeting Domain
cuggagcuggcugucuggcugguu

SEQ ID NO: 1441 - RNA, 18 nt, Artificial Sequence
  Targeting Domain
agcgagggccugaagcua

SEQ ID NO: 1442 - RNA, 19 nt, Artificial Sequence
  Targeting Domain
cagcgagggccugaagcua

SEQ ID NO: 1443 - RNA, 20 nt, Artificial Sequence
  Targeting Domain
ucagcgagggccugaagcua

SEQ ID NO: 1444 - RNA, 21 nt, Artificial Sequence
  Targeting Domain
cucagcgagggccugaagcua

SEQ ID NO: 1445 - RNA, 22 nt, Artificial Sequence
  Targeting Domain
ccucagcgagggccugaagcua

SEQ ID NO: 1446 - RNA, 23 nt, Artificial Sequence
  Targeting Domain
uccucagcgagggccugaagcua

SEQ ID NO: 1447 - RNA, 24 nt, Artificial Sequence
  Targeting Domain
uuccucagcgagggccugaagcua

SEQ ID NO: 1448 - RNA, 21 nt, Artificial Sequence
  Targeting Domain
cacgaugaaauccuggagggc

SEQ ID NO: 1449 - RNA, 22 nt, Artificial Sequence
  Targeting Domain
ucacgaugaaauccuggagggc

SEQ ID NO: 1450 - RNA, 23 nt, Artificial Sequence
  Targeting Domain
cucacgaugaaauccuggagggc

SEQ ID NO: 1451 - RNA, 24 nt, Artificial Sequence
  Targeting Domain
acucacgaugaaauccuggagggc

SEQ ID NO: 1452 - RNA, 18 nt, Artificial Sequence
  Targeting Domain
aucaacgauuacguggag

SEQ ID NO: 1453 - RNA, 20 nt, Artificial Sequence
  Targeting Domain
agaucaacgauuacguggag

SEQ ID NO: 1454 - RNA, 21 nt, Artificial Sequence
  Targeting Domain
cagaucaacgauuacguggag

SEQ ID NO: 1455 - RNA, 22 nt, Artificial Sequence
  Targeting Domain
acagaucaacgauuacguggag

SEQ ID NO: 1456 - RNA, 23 nt, Artificial Sequence
  Targeting Domain
aacagaucaacgauuacguggag

SEQ ID NO: 1457 - RNA, 24 nt, Artificial Sequence
  Targeting Domain
aaacagaucaacgauuacguggag

SEQ ID NO: 1458 - RNA, 18 nt, Artificial Sequence
  Targeting Domain
agaucacccccaaccugg

SEQ ID NO: 1459 - RNA, 19 nt, Artificial Sequence
  Targeting Domain
aagaucacccccaaccugg

SEQ ID NO: 1460 - RNA, 20 nt, Artificial Sequence
  Targeting Domain
caagaucacccccaaccugg

SEQ ID NO: 1461 - RNA, 21 nt, Artificial Sequence
  Targeting Domain
acaagaucacccccaaccugg

SEQ ID NO: 1462 - RNA, 22 nt, Artificial Sequence
  Targeting Domain
aacaagaucacccccaaccugg

SEQ ID NO: 1463 - RNA, 23 nt, Artificial Sequence
  Targeting Domain
caacaagaucacccccaaccugg

SEQ ID NO: 1464 - RNA, 24 nt, Artificial Sequence
  Targeting Domain
ucaacaagaucacccccaaccugg

SEQ ID NO: 1465 - RNA, 21 nt, Artificial Sequence
  Targeting Domain
agagacacaguuuuugcucug

SEQ ID NO: 1466 - RNA, 22 nt, Artificial Sequence
  Targeting Domain
cagagacacaguuuuugcucug

SEQ ID NO: 1467 - RNA, 23 nt, Artificial Sequence
  Targeting Domain
acagagacacaguuuuugcucug

SEQ ID NO: 1468 - RNA, 21 nt, Artificial Sequence
  Targeting Domain
aagcuaguggauaaguuuuug

SEQ ID NO: 1469 - RNA, 23 nt, Artificial Sequence
  Targeting Domain
ugaagcuaguggauaaguuuuug

SEQ ID NO: 1470 - RNA, 24 nt, Artificial Sequence
  Targeting Domain
cugaagcuaguggauaaguuuuug

SEQ ID NO: 1471 - RNA, 19 nt, Artificial Sequence
  Targeting Domain
agauacaucccaccaugau

SEQ ID NO: 1472 - RNA, 20 nt, Artificial Sequence
  Targeting Domain
cagauacaucccaccaugau

SEQ ID NO: 1473 - RNA, 21 nt, Artificial Sequence
  Targeting Domain
acagauacaucccaccaugau

SEQ ID NO: 1474 - RNA, 23 nt, Artificial Sequence
  Targeting Domain
agacagauacaucccaccaugau

SEQ ID NO: 1475 - RNA, 24 nt, Artificial Sequence
  Targeting Domain
aagacagauacaucccaccaugau

SEQ ID NO: 1476 - RNA, 21 nt, Artificial Sequence
  Targeting Domain
cuggucccugucucccuggcu

SEQ ID NO: 1477 - RNA, 22 nt, Artificial Sequence
  Targeting Domain
ccuggucccugucucccuggcu

SEQ ID NO: 1478 - RNA, 24 nt, Artificial Sequence
  Targeting Domain
ugccuggucccugucucccuggcu

SEQ ID NO: 1479 - RNA, 21 nt, Artificial Sequence
  Targeting Domain
aaggguacucaagggaaaauu

SEQ ID NO: 1480 - RNA, 23 nt, Artificial Sequence
  Targeting Domain
agaaggguacucaagggaaaauu

SEQ ID NO: 1481 - RNA, 18 nt, Artificial Sequence
  Targeting Domain
gcccuccaggauuucauc

SEQ ID NO: 1482 - RNA, 19 nt, Artificial Sequence
  Targeting Domain
ggcccuccaggauuucauc

SEQ ID NO: 1483 - RNA, 18 nt, Artificial Sequence
  Targeting Domain
guugaaauucaggcccuc

SEQ ID NO: 1484 - RNA, 19 nt, Artificial Sequence
  Targeting Domain
gguugaaauucaggcccuc

SEQ ID NO: 1485 - RNA, 18 nt, Artificial Sequence
  Targeting Domain
gaguuccuggaagccuuc

SEQ ID NO: 1486 - RNA, 19 nt, Artificial Sequence
  Targeting Domain
ggaguuccuggaagccuuc

SEQ ID NO: 1487 - RNA, 18 nt, Artificial Sequence
  Targeting Domain
gcacaggccugccagcag

SEQ ID NO: 1488 - RNA, 21 nt, Artificial Sequence
  Targeting Domain
gcagcacaggccugccagcag

SEQ ID NO: 1489 - RNA, 22 nt, Artificial Sequence
  Targeting Domain
ggcagcacaggccugccagcag

SEQ ID NO: 1490 - RNA, 20 nt, Artificial Sequence
  Targeting Domain
gaaguugacagugaaggcuu

SEQ ID NO: 1491 - RNA, 19 nt, Artificial Sequence
  Targeting Domain
gcuggcugucuggcugguu

SEQ ID NO: 1492 - RNA, 18 nt, Artificial Sequence
  Targeting Domain
gaugaaauccuggagggc

SEQ ID NO: 1493 - RNA, 18 nt, Artificial Sequence
  Targeting Domain
gacacaguuuuugcucug

SEQ ID NO: 1494 - RNA, 20 nt, Artificial Sequence
  Targeting Domain
gagacacaguuuuugcucug

SEQ ID NO: 1495 - RNA, 19 nt, Artificial Sequence
  Targeting Domain
gcuaguggauaaguuuuug

SEQ ID NO: 1496 - RNA, 18 nt, Artificial Sequence
  Targeting Domain
gucccugucucccuggcu

SEQ ID NO: 1497 - RNA, 19 nt, Artificial Sequence
  Targeting Domain
ggucccugucucccuggcu

SEQ ID NO: 1498 - RNA, 18 nt, Artificial Sequence
  Targeting Domain
gguacucaagggaaaauu

SEQ ID NO: 1499 - RNA, 19 nt, Artificial Sequence
  Targeting Domain
ggguacucaagggaaaauu

SEQ ID NO: 1500 - RNA, 18 nt, Artificial Sequence
  Targeting Domain
caaauccacaauuuuccc

SEQ ID NO: 1501 - RNA, 19 nt, Artificial Sequence
  Targeting Domain
ccaaauccacaauuuuccc

SEQ ID NO: 1502 - RNA, 20 nt, Artificial Sequence
  Targeting Domain
accaaauccacaauuuuccc

SEQ ID NO: 1503 - RNA, 20 nt, Artificial Sequence
  Targeting Domain
aggcccuccaggauuucauc

SEQ ID NO: 1504 - RNA, 20 nt, Artificial Sequence
  Targeting Domain
agguugaaauucaggcccuc

SEQ ID NO: 1505 - RNA, 20 nt, Artificial Sequence
  Targeting Domain
aggaguuccuggaagccuuc

SEQ ID NO: 1506 - RNA, 19 nt, Artificial Sequence
  Targeting Domain
agcacaggccugccagcag

SEQ ID NO: 1507 - RNA, 20 nt, Artificial Sequence
  Targeting Domain
cagcacaggccugccagcag

SEQ ID NO: 1508 - RNA, 23 nt, Artificial Sequence
  Targeting Domain
aggcagcacaggccugccagcag

SEQ ID NO: 1509 - RNA, 24 nt, Artificial Sequence
  Targeting Domain
caggcagcacaggccugccagcag

SEQ ID NO: 1510 - RNA, 18 nt, Artificial Sequence
  Targeting Domain
ucugggcagcaucucccu

SEQ ID NO: 1511 - RNA, 19 nt, Artificial Sequence
  Targeting Domain
uucugggcagcaucucccu

SEQ ID NO: 1512 - RNA, 18 nt, Artificial Sequence
  Targeting Domain
aguugacagugaaggcuu

SEQ ID NO: 1513 - RNA, 19 nt, Artificial Sequence
  Targeting Domain
aaguugacagugaaggcuu

SEQ ID NO: 1514 - RNA, 18 nt, Artificial Sequence
  Targeting Domain
cuggcugucuggcugguu

SEQ ID NO: 1515 - RNA, 20 nt, Artificial Sequence
  Targeting Domain
agcuggcugucuggcugguu

SEQ ID NO: 1516 - RNA, 19 nt, Artificial Sequence
  Targeting Domain
cgaugaaauccuggagggc

SEQ ID NO: 1517 - RNA, 20 nt, Artificial Sequence
  Targeting Domain
acgaugaaauccuggagggc

SEQ ID NO: 1518 - RNA, 19 nt, Artificial Sequence
  Targeting Domain
agacacaguuuuugcucug

SEQ ID NO: 1519 - RNA, 18 nt, Artificial Sequence
  Targeting Domain
cuaguggauaaguuuuug

SEQ ID NO: 1520 - RNA, 20 nt, Artificial Sequence
  Targeting Domain
agcuaguggauaaguuuuug

SEQ ID NO: 1521 - RNA, 20 nt, Artificial Sequence
  Targeting Domain
uggucccugucucccuggcu

SEQ ID NO: 1522 - RNA, 20 nt, Artificial Sequence
  Targeting Domain
aggguacucaagggaaaauu

SEQ ID NO: 1523 - RNA, 18 nt, Artificial Sequence
  Targeting Domain
guguccccgaaguugaca

SEQ ID NO: 1524 - RNA, 19 nt, Artificial Sequence
  Targeting Domain
gguguccccgaaguugaca

SEQ ID NO: 1525 - RNA, 20 nt, Artificial Sequence
  Targeting Domain
cgguguccccgaaguugaca

SEQ ID NO: 1526 - RNA, 21 nt, Artificial Sequence
  Targeting Domain
ucgguguccccgaaguugaca

SEQ ID NO: 1527 - RNA, 22 nt, Artificial Sequence
  Targeting Domain
uucgguguccccgaaguugaca

SEQ ID NO: 1528 - RNA, 23 nt, Artificial Sequence
  Targeting Domain
cuucgguguccccgaaguugaca

SEQ ID NO: 1529 - RNA, 24 nt, Artificial Sequence
  Targeting Domain
ucuucgguguccccgaaguugaca

SEQ ID NO: 1530 - RNA, 18 nt, Artificial Sequence
  Targeting Domain
ugucagccuuggucccca

SEQ ID NO: 1531 - RNA, 19 nt, Artificial Sequence
  Targeting Domain
gugucagccuuggucccca

SEQ ID NO: 1532 - RNA, 21 nt, Artificial Sequence
  Targeting Domain
gagugucagccuuggucccca

SEQ ID NO: 1533 - RNA, 22 nt, Artificial Sequence
  Targeting Domain
ugagugucagccuuggucccca

SEQ ID NO: 1534 - RNA, 23 nt, Artificial Sequence
  Targeting Domain
gugagugucagccuuggucccca

SEQ ID NO: 1535 - RNA, 24 nt, Artificial Sequence
  Targeting Domain
cgugagugucagccuuggucccca

SEQ ID NO: 1536 - RNA, 18 nt, Artificial Sequence
  Targeting Domain
ccuggggauccucagcca

SEQ ID NO: 1537 - RNA, 19 nt, Artificial Sequence
  Targeting Domain
cccuggggauccucagcca

SEQ ID NO: 1538 - RNA, 21 nt, Artificial Sequence
  Targeting Domain
cucccuggggauccucagcca

SEQ ID NO: 1539 - RNA, 22 nt, Artificial Sequence
  Targeting Domain
ucucccuggggauccucagcca

SEQ ID NO: 1540 - RNA, 23 nt, Artificial Sequence
  Targeting Domain
aucucccuggggauccucagcca

SEQ ID NO: 1541 - RNA, 24 nt, Artificial Sequence
  Targeting Domain
caucucccuggggauccucagcca

SEQ ID NO: 1542 - RNA, 18 nt, Artificial Sequence
  Targeting Domain
aggcuguagcgaugcuca

SEQ ID NO: 1543 - RNA, 19 nt, Artificial Sequence
  Targeting Domain
aaggcuguagcgaugcuca

SEQ ID NO: 1544 - RNA, 20 nt, Artificial Sequence
  Targeting Domain
aaaggcuguagcgaugcuca

SEQ ID NO: 1545 - RNA, 21 nt, Artificial Sequence
  Targeting Domain
caaaggcuguagcgaugcuca

SEQ ID NO: 1546 - RNA, 22 nt, Artificial Sequence
  Targeting Domain
gcaaaggcuguagcgaugcuca

SEQ ID NO: 1547 - RNA, 23 nt, Artificial Sequence
  Targeting Domain
ugcaaaggcuguagcgaugcuca

SEQ ID NO: 1548 - RNA, 24 nt, Artificial Sequence
  Targeting Domain
uugcaaaggcuguagcgaugcuca

SEQ ID NO: 1549 - RNA, 18 nt, Artificial Sequence
  Targeting Domain
cggcauuguccugcaaga

SEQ ID NO: 1550 - RNA, 19 nt, Artificial Sequence
  Targeting Domain
acggcauuguccugcaaga

SEQ ID NO: 1551 - RNA, 20 nt, Artificial Sequence
  Targeting Domain
gacggcauuguccugcaaga

SEQ ID NO: 1552 - RNA, 21 nt, Artificial Sequence
  Targeting Domain
agacggcauuguccugcaaga

SEQ ID NO: 1553 - RNA, 22 nt, Artificial Sequence
  Targeting Domain
aagacggcauuguccugcaaga

SEQ ID NO: 1554 - RNA, 23 nt, Artificial Sequence
  Targeting Domain
gaagacggcauuguccugcaaga

SEQ ID NO: 1555 - RNA, 24 nt, Artificial Sequence
  Targeting Domain
agaagacggcauuguccugcaaga

SEQ ID NO: 1556 - RNA, 18 nt, Artificial Sequence
  Targeting Domain
uguccugcaagacagaga

SEQ ID NO: 1557 - RNA, 19 nt, Artificial Sequence
  Targeting Domain
uuguccugcaagacagaga

SEQ ID NO: 1558 - RNA, 21 nt, Artificial Sequence
  Targeting Domain
cauuguccugcaagacagaga

SEQ ID NO: 1559 - RNA, 22 nt, Artificial Sequence
  Targeting Domain
gcauuguccugcaagacagaga

SEQ ID NO: 1560 - RNA, 23 nt, Artificial Sequence
  Targeting Domain
ggcauuguccugcaagacagaga

SEQ ID NO: 1561 - RNA, 24 nt, Artificial Sequence
  Targeting Domain
cggcauuguccugcaagacagaga

SEQ ID NO: 1562 - RNA, 18 nt, Artificial Sequence
  Targeting Domain
ggaggaugccccacgaga

SEQ ID NO: 1563 - RNA, 19 nt, Artificial Sequence
  Targeting Domain
aggaggaugccccacgaga

SEQ ID NO: 1564 - RNA, 20 nt, Artificial Sequence
  Targeting Domain
caggaggaugccccacgaga

SEQ ID NO: 1565 - RNA, 21 nt, Artificial Sequence
  Targeting Domain
gcaggaggaugccccacgaga

SEQ ID NO: 1566 - RNA, 22 nt, Artificial Sequence
  Targeting Domain
agcaggaggaugccccacgaga

SEQ ID NO: 1567 - RNA, 23 nt, Artificial Sequence
  Targeting Domain
cagcaggaggaugccccacgaga

SEQ ID NO: 1568 - RNA, 24 nt, Artificial Sequence
  Targeting Domain
ccagcaggaggaugccccacgaga

SEQ ID NO: 1569 - RNA, 18 nt, Artificial Sequence
  Targeting Domain
gauccucagccagggaga

SEQ ID NO: 1570 - RNA, 19 nt, Artificial Sequence
  Targeting Domain
ggauccucagccagggaga

SEQ ID NO: 1571 - RNA, 20 nt, Artificial Sequence
  Targeting Domain
gggauccucagccagggaga

SEQ ID NO: 1572 - RNA, 21 nt, Artificial Sequence
  Targeting Domain
ggggauccucagccagggaga

SEQ ID NO: 1573 - RNA, 22 nt, Artificial Sequence
  Targeting Domain
uggggauccucagccagggaga

SEQ ID NO: 1574 - RNA, 23 nt, Artificial Sequence
  Targeting Domain
cuggggauccucagccagggaga

SEQ ID NO: 1575 - RNA, 24 nt, Artificial Sequence
  Targeting Domain
ccuggggauccucagccagggaga

SEQ ID NO: 1576 - RNA, 18 nt, Artificial Sequence
  Targeting Domain
ucuggcugguugagggua

SEQ ID NO: 1577 - RNA, 19 nt, Artificial Sequence
  Targeting Domain
gucuggcugguugagggua

SEQ ID NO: 1578 - RNA, 21 nt, Artificial Sequence
  Targeting Domain
cugucuggcugguugagggua

SEQ ID NO: 1579 - RNA, 22 nt, Artificial Sequence
  Targeting Domain
gcugucuggcugguugagggua

SEQ ID NO: 1580 - RNA, 23 nt, Artificial Sequence
  Targeting Domain
ggcugucuggcugguugagggua

SEQ ID NO: 1581 - RNA, 24 nt, Artificial Sequence
  Targeting Domain
uggcugucuggcugguugagggua

SEQ ID NO: 1582 - RNA, 18 nt, Artificial Sequence
  Targeting Domain
ugagcaaccuuaccuuua

SEQ ID NO: 1583 - RNA, 19 nt, Artificial Sequence
  Targeting Domain
uugagcaaccuuaccuuua

SEQ ID NO: 1584 - RNA, 20 nt, Artificial Sequence
  Targeting Domain
guugagcaaccuuaccuuua

SEQ ID NO: 1585 - RNA, 21 nt, Artificial Sequence
  Targeting Domain
gguugagcaaccuuaccuuua

SEQ ID NO: 1586 - RNA, 22 nt, Artificial Sequence
  Targeting Domain
ugguugagcaaccuuaccuuua

SEQ ID NO: 1587 - RNA, 23 nt, Artificial Sequence
  Targeting Domain
cugguugagcaaccuuaccuuua

SEQ ID NO: 1588 - RNA, 24 nt, Artificial Sequence
  Targeting Domain
gcugguugagcaaccuuaccuuua

SEQ ID NO: 1589 - RNA, 18 nt, Artificial Sequence
  Targeting Domain
ggcuguagcgaugcucac

SEQ ID NO: 1590 - RNA, 19 nt, Artificial Sequence
  Targeting Domain
aggcuguagcgaugcucac

SEQ ID NO: 1591 - RNA, 21 nt, Artificial Sequence
  Targeting Domain
aaaggcuguagcgaugcucac

SEQ ID NO: 1592 - RNA, 22 nt, Artificial Sequence
  Targeting Domain
caaaggcuguagcgaugcucac

SEQ ID NO: 1593 - RNA, 23 nt, Artificial Sequence
  Targeting Domain
gcaaaggcuguagcgaugcucac

SEQ ID NO: 1594 - RNA, 24 nt, Artificial Sequence
  Targeting Domain
ugcaaaggcuguagcgaugcucac

SEQ ID NO: 1595 - RNA, 18 nt, Artificial Sequence
  Targeting Domain
aaagaagauguaauucac

SEQ ID NO: 1596 - RNA, 19 nt, Artificial Sequence
  Targeting Domain
uaaagaagauguaauucac

SEQ ID NO: 1597 - RNA, 20 nt, Artificial Sequence
  Targeting Domain
uuaaagaagauguaauucac

SEQ ID NO: 1598 - RNA, 21 nt, Artificial Sequence
  Targeting Domain
uuuaaagaagauguaauucac

SEQ ID NO: 1599 - RNA, 22 nt, Artificial Sequence
  Targeting Domain
cuuuaaagaagauguaauucac

SEQ ID NO: 1600 - RNA, 23 nt, Artificial Sequence
  Targeting Domain
ccuuuaaagaagauguaauucac

SEQ ID NO: 1601 - RNA, 24 nt, Artificial Sequence
  Targeting Domain
accuuuaaagaagauguaauucac

SEQ ID NO: 1602 - RNA, 18 nt, Artificial Sequence
  Targeting Domain
auccucagccagggagac

SEQ ID NO: 1603 - RNA, 19 nt, Artificial Sequence
  Targeting Domain
gauccucagccagggagac

SEQ ID NO: 1604 - RNA, 20 nt, Artificial Sequence
  Targeting Domain
ggauccucagccagggagac

SEQ ID NO: 1605 - RNA, 21 nt, Artificial Sequence
  Targeting Domain
gggauccucagccagggagac

SEQ ID NO: 1606 - RNA, 22 nt, Artificial Sequence
  Targeting Domain
ggggauccucagccagggagac

SEQ ID NO: 1607 - RNA, 23 nt, Artificial Sequence
  Targeting Domain
uggggauccucagccagggagac

SEQ ID NO: 1608 - RNA, 24 nt, Artificial Sequence
  Targeting Domain
cuggggauccucagccagggagac

SEQ ID NO: 1609 - RNA, 18 nt, Artificial Sequence
  Targeting Domain
ccagcaggaggaugcccc

SEQ ID NO: 1610 - RNA, 19 nt, Artificial Sequence
  Targeting Domain
gccagcaggaggaugcccc

SEQ ID NO: 1611 - RNA, 20 nt, Artificial Sequence
  Targeting Domain
ugccagcaggaggaugcccc

SEQ ID NO: 1612 - RNA, 21 nt, Artificial Sequence
  Targeting Domain
cugccagcaggaggaugcccc

SEQ ID NO: 1613 - RNA, 22 nt, Artificial Sequence
  Targeting Domain
ccugccagcaggaggaugcccc

SEQ ID NO: 1614 - RNA, 23 nt, Artificial Sequence
  Targeting Domain
gccugccagcaggaggaugcccc

SEQ ID NO: 1615 - RNA, 24 nt, Artificial Sequence
  Targeting Domain
ggccugccagcaggaggaugcccc

SEQ ID NO: 1616 - RNA, 18 nt, Artificial Sequence
  Targeting Domain
gugucagccuuggucccc

SEQ ID NO: 1617 - RNA, 19 nt, Artificial Sequence
  Targeting Domain
agugucagccuuggucccc

SEQ ID NO: 1618 - RNA, 20 nt, Artificial Sequence
  Targeting Domain
gagugucagccuuggucccc

SEQ ID NO: 1619 - RNA, 21 nt, Artificial Sequence
  Targeting Domain
ugagugucagccuuggucccc

SEQ ID NO: 1620 - RNA, 22 nt, Artificial Sequence
  Targeting Domain
gugagugucagccuuggucccc

SEQ ID NO: 1621 - RNA, 23 nt, Artificial Sequence
  Targeting Domain
cgugagugucagccuuggucccc

SEQ ID NO: 1622 - RNA, 24 nt, Artificial Sequence
  Targeting Domain
ucgugagugucagccuuggucccc

SEQ ID NO: 1623 - RNA, 18 nt, Artificial Sequence
  Targeting Domain
uucugggcagcaucuccc

SEQ ID NO: 1624 - RNA, 19 nt, Artificial Sequence
  Targeting Domain
cuucugggcagcaucuccc

SEQ ID NO: 1625 - RNA, 21 nt, Artificial Sequence
  Targeting Domain
gucuucugggcagcaucuccc

SEQ ID NO: 1626 - RNA, 22 nt, Artificial Sequence
  Targeting Domain
ugucuucugggcagcaucuccc

SEQ ID NO: 1627 - RNA, 23 nt, Artificial Sequence
  Targeting Domain
cugucuucugggcagcaucuccc

SEQ ID NO: 1628 - RNA, 24 nt, Artificial Sequence
  Targeting Domain
ucugucuucugggcagcaucuccc

SEQ ID NO: 1629 - RNA, 18 nt, Artificial Sequence
  Targeting Domain
agugucagccuugguccc

SEQ ID NO: 1630 - RNA, 19 nt, Artificial Sequence
  Targeting Domain
gagugucagccuugguccc

SEQ ID NO: 1631 - RNA, 20 nt, Artificial Sequence
  Targeting Domain
ugagugucagccuugguccc

SEQ ID NO: 1632 - RNA, 21 nt, Artificial Sequence
  Targeting Domain
gugagugucagccuugguccc

SEQ ID NO: 1633 - RNA, 22 nt, Artificial Sequence
  Targeting Domain
cgugagugucagccuugguccc

SEQ ID NO: 1634 - RNA, 23 nt, Artificial Sequence
  Targeting Domain
ucgugagugucagccuugguccc

SEQ ID NO: 1635 - RNA, 24 nt, Artificial Sequence
  Targeting Domain
aucgugagugucagccuugguccc

SEQ ID NO: 1636 - RNA, 18 nt, Artificial Sequence
  Targeting Domain
cccuggggauccucagcc

SEQ ID NO: 1637 - RNA, 19 nt, Artificial Sequence
  Targeting Domain
ucccuggggauccucagcc

SEQ ID NO: 1638 - RNA, 21 nt, Artificial Sequence
  Targeting Domain
ucucccuggggauccucagcc

SEQ ID NO: 1639 - RNA, 22 nt, Artificial Sequence
  Targeting Domain
aucucccuggggauccucagcc

SEQ ID NO: 1640 - RNA, 23 nt, Artificial Sequence
  Targeting Domain
caucucccuggggauccucagcc

SEQ ID NO: 1641 - RNA, 24 nt, Artificial Sequence
  Targeting Domain
gcaucucccuggggauccucagcc

SEQ ID NO: 1642 - RNA, 18 nt, Artificial Sequence
  Targeting Domain
ugagccuccggaaucucc

SEQ ID NO: 1643 - RNA, 19 nt, Artificial Sequence
  Targeting Domain
cugagccuccggaaucucc

SEQ ID NO: 1644 - RNA, 20 nt, Artificial Sequence
  Targeting Domain
ucugagccuccggaaucucc

SEQ ID NO: 1645 - RNA, 21 nt, Artificial Sequence
  Targeting Domain
aucugagccuccggaaucucc

SEQ ID NO: 1646 - RNA, 22 nt, Artificial Sequence
  Targeting Domain
gaucugagccuccggaaucucc

SEQ ID NO: 1647 - RNA, 23 nt, Artificial Sequence
  Targeting Domain
ggaucugagccuccggaaucucc

SEQ ID NO: 1648 - RNA, 24 nt, Artificial Sequence
  Targeting Domain
uggaucugagccuccggaaucucc

SEQ ID NO: 1649 - RNA, 18 nt, Artificial Sequence
  Targeting Domain
cuucugggcagcaucucc

SEQ ID NO: 1650 - RNA, 19 nt, Artificial Sequence
  Targeting Domain
ucuucugggcagcaucucc

SEQ ID NO: 1651 - RNA, 20 nt, Artificial Sequence
  Targeting Domain
gucuucugggcagcaucucc

SEQ ID NO: 1652 - RNA, 21 nt, Artificial Sequence
  Targeting Domain
ugucuucugggcagcaucucc

SEQ ID NO: 1653 - RNA, 22 nt, Artificial Sequence
  Targeting Domain
cugucuucugggcagcaucucc

SEQ ID NO: 1654 - RNA, 23 nt, Artificial Sequence
  Targeting Domain
ucugucuucugggcagcaucucc

SEQ ID NO: 1655 - RNA, 24 nt, Artificial Sequence
  Targeting Domain
aucugucuucugggcagcaucucc

SEQ ID NO: 1656 - RNA, 18 nt, Artificial Sequence
  Targeting Domain
uuggccucuucggugucc

SEQ ID NO: 1657 - RNA, 19 nt, Artificial Sequence
  Targeting Domain
cuuggccucuucggugucc

SEQ ID NO: 1658 - RNA, 20 nt, Artificial Sequence
  Targeting Domain
ucuuggccucuucggugucc

SEQ ID NO: 1659 - RNA, 21 nt, Artificial Sequence
  Targeting Domain
uucuuggccucuucggugucc

SEQ ID NO: 1660 - RNA, 22 nt, Artificial Sequence
  Targeting Domain
uuucuuggccucuucggugucc

SEQ ID NO: 1661 - RNA, 23 nt, Artificial Sequence
  Targeting Domain
guuucuuggccucuucggugucc

SEQ ID NO: 1662 - RNA, 24 nt, Artificial Sequence
  Targeting Domain
uguuucuuggccucuucggugucc

SEQ ID NO: 1663 - RNA, 18 nt, Artificial Sequence
  Targeting Domain
aggguacggaggaguucc

SEQ ID NO: 1664 - RNA, 19 nt, Artificial Sequence
  Targeting Domain
gaggguacggaggaguucc

SEQ ID NO: 1665 - RNA, 21 nt, Artificial Sequence
  Targeting Domain
uugaggguacggaggaguucc

SEQ ID NO: 1666 - RNA, 22 nt, Artificial Sequence
  Targeting Domain
guugaggguacggaggaguucc

SEQ ID NO: 1667 - RNA, 23 nt, Artificial Sequence
  Targeting Domain
gguugaggguacggaggaguucc

SEQ ID NO: 1668 - RNA, 24 nt, Artificial Sequence
  Targeting Domain
ugguugaggguacggaggaguucc

SEQ ID NO: 1669 - RNA, 18 nt, Artificial Sequence
  Targeting Domain
cagcacaggccugccagc

SEQ ID NO: 1670 - RNA, 19 nt, Artificial Sequence
  Targeting Domain
gcagcacaggccugccagc

SEQ ID NO: 1671 - RNA, 20 nt, Artificial Sequence
  Targeting Domain
ggcagcacaggccugccagc

SEQ ID NO: 1672 - RNA, 21 nt, Artificial Sequence
  Targeting Domain
aggcagcacaggccugccagc

SEQ ID NO: 1673 - RNA, 22 nt, Artificial Sequence
  Targeting Domain
caggcagcacaggccugccagc

SEQ ID NO: 1674 - RNA, 23 nt, Artificial Sequence
  Targeting Domain
ccaggcagcacaggccugccagc

SEQ ID NO: 1675 - RNA, 24 nt, Artificial Sequence
  Targeting Domain
accaggcagcacaggccugccagc

SEQ ID NO: 1676 - RNA, 18 nt, Artificial Sequence
  Targeting Domain
ucccuggggauccucagc

SEQ ID NO: 1677 - RNA, 19 nt, Artificial Sequence
  Targeting Domain
cucccuggggauccucagc

SEQ ID NO: 1678 - RNA, 20 nt, Artificial Sequence
  Targeting Domain
ucucccuggggauccucagc

SEQ ID NO: 1679 - RNA, 21 nt, Artificial Sequence
  Targeting Domain
aucucccuggggauccucagc

SEQ ID NO: 1680 - RNA, 22 nt, Artificial Sequence
  Targeting Domain
caucucccuggggauccucagc

SEQ ID NO: 1681 - RNA, 23 nt, Artificial Sequence
  Targeting Domain
gcaucucccuggggauccucagc

SEQ ID NO: 1682 - RNA, 24 nt, Artificial Sequence
  Targeting Domain
agcaucucccuggggauccucagc

SEQ ID NO: 1683 - RNA, 18 nt, Artificial Sequence
  Targeting Domain
ccauugccgguggucagc

SEQ ID NO: 1684 - RNA, 19 nt, Artificial Sequence
  Targeting Domain
gccauugccgguggucagc

SEQ ID NO: 1685 - RNA, 20 nt, Artificial Sequence
  Targeting Domain
ggccauugccgguggucagc

SEQ ID NO: 1686 - RNA, 21 nt, Artificial Sequence
  Targeting Domain
aggccauugccgguggucagc

SEQ ID NO: 1687 - RNA, 22 nt, Artificial Sequence
  Targeting Domain
caggccauugccgguggucagc

SEQ ID NO: 1688 - RNA, 23 nt, Artificial Sequence
  Targeting Domain
acaggccauugccgguggucagc

SEQ ID NO: 1689 - RNA, 24 nt, Artificial Sequence
  Targeting Domain
aacaggccauugccgguggucagc

SEQ ID NO: 1690 - RNA, 18 nt, Artificial Sequence
  Targeting Domain
gaggguacggaggaguuc

SEQ ID NO: 1691 - RNA, 19 nt, Artificial Sequence
  Targeting Domain
ugaggguacggaggaguuc

SEQ ID NO: 1692 - RNA, 20 nt, Artificial Sequence
  Targeting Domain
uugaggguacggaggaguuc

SEQ ID NO: 1693 - RNA, 21 nt, Artificial Sequence
  Targeting Domain
guugaggguacggaggaguuc

SEQ ID NO: 1694 - RNA, 22 nt, Artificial Sequence
  Targeting Domain
gguugaggguacggaggaguuc

SEQ ID NO: 1695 - RNA, 23 nt, Artificial Sequence
  Targeting Domain
ugguugaggguacggaggaguuc

SEQ ID NO: 1696 - RNA, 24 nt, Artificial Sequence
  Targeting Domain
cugguugaggguacggaggaguuc

SEQ ID NO: 1697 - RNA, 18 nt, Artificial Sequence
  Targeting Domain
uggcgguauaggcugaag

SEQ ID NO: 1698 - RNA, 19 nt, Artificial Sequence
  Targeting Domain
cuggcgguauaggcugaag

SEQ ID NO: 1699 - RNA, 20 nt, Artificial Sequence
  Targeting Domain
gcuggcgguauaggcugaag

SEQ ID NO: 1700 - RNA, 21 nt, Artificial Sequence
  Targeting Domain
agcuggcgguauaggcugaag

SEQ ID NO: 1701 - RNA, 22 nt, Artificial Sequence
  Targeting Domain
cagcuggcgguauaggcugaag

SEQ ID NO: 1702 - RNA, 23 nt, Artificial Sequence
  Targeting Domain
ccagcuggcgguauaggcugaag

SEQ ID NO: 1703 - RNA, 24 nt, Artificial Sequence
  Targeting Domain
gccagcuggcgguauaggcugaag

SEQ ID NO: 1704 - RNA, 18 nt, Artificial Sequence
  Targeting Domain
gcagcacaggccugccag

SEQ ID NO: 1705 - RNA, 19 nt, Artificial Sequence
  Targeting Domain
ggcagcacaggccugccag

SEQ ID NO: 1706 - RNA, 20 nt, Artificial Sequence
  Targeting Domain
aggcagcacaggccugccag

SEQ ID NO: 1707 - RNA, 21 nt, Artificial Sequence
  Targeting Domain
caggcagcacaggccugccag

SEQ ID NO: 1708 - RNA, 22 nt, Artificial Sequence
  Targeting Domain
ccaggcagcacaggccugccag

SEQ ID NO: 1709 - RNA, 23 nt, Artificial Sequence
  Targeting Domain
accaggcagcacaggccugccag

SEQ ID NO: 1710 - RNA, 24 nt, Artificial Sequence
  Targeting Domain
gaccaggcagcacaggccugccag

SEQ ID NO: 1711 - RNA, 18 nt, Artificial Sequence
  Targeting Domain
gccauugccgguggucag

SEQ ID NO: 1712 - RNA, 19 nt, Artificial Sequence
  Targeting Domain
ggccauugccgguggucag

SEQ ID NO: 1713 - RNA, 20 nt, Artificial Sequence
  Targeting Domain
aggccauugccgguggucag

SEQ ID NO: 1714 - RNA, 21 nt, Artificial Sequence
  Targeting Domain
caggccauugccgguggucag

SEQ ID NO: 1715 - RNA, 22 nt, Artificial Sequence
  Targeting Domain
acaggccauugccgguggucag

SEQ ID NO: 1716 - RNA, 23 nt, Artificial Sequence
  Targeting Domain
aacaggccauugccgguggucag

SEQ ID NO: 1717 - RNA, 24 nt, Artificial Sequence
  Targeting Domain
gaacaggccauugccgguggucag

SEQ ID NO: 1718 - RNA, 18 nt, Artificial Sequence
  Targeting Domain
uuguccugcaagacagag

SEQ ID NO: 1719 - RNA, 19 nt, Artificial Sequence
  Targeting Domain
auuguccugcaagacagag

SEQ ID NO: 1720 - RNA, 20 nt, Artificial Sequence
  Targeting Domain
cauuguccugcaagacagag

SEQ ID NO: 1721 - RNA, 21 nt, Artificial Sequence
  Targeting Domain
gcauuguccugcaagacagag

SEQ ID NO: 1722 - RNA, 22 nt, Artificial Sequence
  Targeting Domain
ggcauuguccugcaagacagag

SEQ ID NO: 1723 - RNA, 23 nt, Artificial Sequence
  Targeting Domain
cggcauuguccugcaagacagag

SEQ ID NO: 1724 - RNA, 24 nt, Artificial Sequence
  Targeting Domain
acggcauuguccugcaagacagag

SEQ ID NO: 1725 - RNA, 18 nt, Artificial Sequence
  Targeting Domain
gcgaugcucacuggggag

SEQ ID NO: 1726 - RNA, 19 nt, Artificial Sequence
  Targeting Domain
agcgaugcucacuggggag

SEQ ID NO: 1727 - RNA, 20 nt, Artificial Sequence
  Targeting Domain
uagcgaugcucacuggggag

SEQ ID NO: 1728 - RNA, 21 nt, Artificial Sequence
  Targeting Domain
guagcgaugcucacuggggag

SEQ ID NO: 1729 - RNA, 22 nt, Artificial Sequence
  Targeting Domain
uguagcgaugcucacuggggag

SEQ ID NO: 1730 - RNA, 23 nt, Artificial Sequence
  Targeting Domain
cuguagcgaugcucacuggggag

SEQ ID NO: 1731 - RNA, 24 nt, Artificial Sequence
  Targeting Domain
gcuguagcgaugcucacuggggag

SEQ ID NO: 1732 - RNA, 18 nt, Artificial Sequence
  Targeting Domain
uggcugguugaggguacg

SEQ ID NO: 1733 - RNA, 19 nt, Artificial Sequence
  Targeting Domain
cuggcugguugaggguacg

SEQ ID NO: 1734 - RNA, 20 nt, Artificial Sequence
  Targeting Domain
ucuggcugguugaggguacg

SEQ ID NO: 1735 - RNA, 21 nt, Artificial Sequence
  Targeting Domain
gucuggcugguugaggguacg

SEQ ID NO: 1736 - RNA, 22 nt, Artificial Sequence
  Targeting Domain
ugucuggcugguugaggguacg

SEQ ID NO: 1737 - RNA, 23 nt, Artificial Sequence
  Targeting Domain
cugucuggcugguugaggguacg

SEQ ID NO: 1738 - RNA, 24 nt, Artificial Sequence
  Targeting Domain
gcugucuggcugguugaggguacg

SEQ ID NO: 1739 - RNA, 18 nt, Artificial Sequence
  Targeting Domain
acuagcuucaggcccucg

SEQ ID NO: 1740 - RNA, 19 nt, Artificial Sequence
  Targeting Domain
cacuagcuucaggcccucg

SEQ ID NO: 1741 - RNA, 20 nt, Artificial Sequence
  Targeting Domain
ccacuagcuucaggcccucg

SEQ ID NO: 1742 - RNA, 21 nt, Artificial Sequence
  Targeting Domain
uccacuagcuucaggcccucg

SEQ ID NO: 1743 - RNA, 22 nt, Artificial Sequence
  Targeting Domain
auccacuagcuucaggcccucg

SEQ ID NO: 1744 - RNA, 23 nt, Artificial Sequence
  Targeting Domain
uauccacuagcuucaggcccucg

SEQ ID NO: 1745 - RNA, 24 nt, Artificial Sequence
  Targeting Domain
uuauccacuagcuucaggcccucg

SEQ ID NO: 1746 - RNA, 18 nt, Artificial Sequence
  Targeting Domain
ucagccuugguccccagg

SEQ ID NO: 1747 - RNA, 19 nt, Artificial Sequence
  Targeting Domain
gucagccuugguccccagg

SEQ ID NO: 1748 - RNA, 20 nt, Artificial Sequence
  Targeting Domain
ugucagccuugguccccagg

SEQ ID NO: 1749 - RNA, 21 nt, Artificial Sequence
  Targeting Domain
gugucagccuugguccccagg

SEQ ID NO: 1750 - RNA, 22 nt, Artificial Sequence
  Targeting Domain
agugucagccuugguccccagg

SEQ ID NO: 1751 - RNA, 23 nt, Artificial Sequence
  Targeting Domain
gagugucagccuugguccccagg

SEQ ID NO: 1752 - RNA, 24 nt, Artificial Sequence
  Targeting Domain
ugagugucagccuugguccccagg

SEQ ID NO: 1753 - RNA, 18 nt, Artificial Sequence
  Targeting Domain
aaggcgaacucagccagg

SEQ ID NO: 1754 - RNA, 19 nt, Artificial Sequence
  Targeting Domain
gaaggcgaacucagccagg

SEQ ID NO: 1755 - RNA, 20 nt, Artificial Sequence
  Targeting Domain
ugaaggcgaacucagccagg

SEQ ID NO: 1756 - RNA, 21 nt, Artificial Sequence
  Targeting Domain
cugaaggcgaacucagccagg

SEQ ID NO: 1757 - RNA, 22 nt, Artificial Sequence
  Targeting Domain
gcugaaggcgaacucagccagg

SEQ ID NO: 1758 - RNA, 23 nt, Artificial Sequence
  Targeting Domain
ggcugaaggcgaacucagccagg

SEQ ID NO: 1759 - RNA, 24 nt, Artificial Sequence
  Targeting Domain
aggcugaaggcgaacucagccagg

SEQ ID NO: 1760 - RNA, 18 nt, Artificial Sequence
  Targeting Domain
uccggaaucuccgugagg

SEQ ID NO: 1761 - RNA, 19 nt, Artificial Sequence
  Targeting Domain
cuccggaaucuccgugagg

SEQ ID NO: 1762 - RNA, 20 nt, Artificial Sequence
  Targeting Domain
ccuccggaaucuccgugagg

SEQ ID NO: 1763 - RNA, 21 nt, Artificial Sequence
  Targeting Domain
gccuccggaaucuccgugagg

SEQ ID NO: 1764 - RNA, 22 nt, Artificial Sequence
  Targeting Domain
agccuccggaaucuccgugagg

SEQ ID NO: 1765 - RNA, 23 nt, Artificial Sequence
  Targeting Domain
gagccuccggaaucuccgugagg

SEQ ID NO: 1766 - RNA, 24 nt, Artificial Sequence
  Targeting Domain
ugagccuccggaaucuccgugagg

SEQ ID NO: 1767 - RNA, 18 nt, Artificial Sequence
  Targeting Domain
gccagcuggcgguauagg

SEQ ID NO: 1768 - RNA, 19 nt, Artificial Sequence
  Targeting Domain
ugccagcuggcgguauagg

SEQ ID NO: 1769 - RNA, 20 nt, Artificial Sequence
  Targeting Domain
gugccagcuggcgguauagg

SEQ ID NO: 1770 - RNA, 21 nt, Artificial Sequence
  Targeting Domain
ugugccagcuggcgguauagg

SEQ ID NO: 1771 - RNA, 22 nt, Artificial Sequence
  Targeting Domain
gugugccagcuggcgguauagg

SEQ ID NO: 1772 - RNA, 23 nt, Artificial Sequence
  Targeting Domain
ggugugccagcuggcgguauagg

SEQ ID NO: 1773 - RNA, 24 nt, Artificial Sequence
  Targeting Domain
uggugugccagcuggcgguauagg

SEQ ID NO: 1774 - RNA, 18 nt, Artificial Sequence
  Targeting Domain
guagcgaugcucacuggg

SEQ ID NO: 1775 - RNA, 19 nt, Artificial Sequence
  Targeting Domain
uguagcgaugcucacuggg

SEQ ID NO: 1776 - RNA, 20 nt, Artificial Sequence
  Targeting Domain
cuguagcgaugcucacuggg

SEQ ID NO: 1777 - RNA, 21 nt, Artificial Sequence
  Targeting Domain
gcuguagcgaugcucacuggg

SEQ ID NO: 1778 - RNA, 22 nt, Artificial Sequence
  Targeting Domain
ggcuguagcgaugcucacuggg

SEQ ID NO: 1779 - RNA, 23 nt, Artificial Sequence
  Targeting Domain
aggcuguagcgaugcucacuggg

SEQ ID NO: 1780 - RNA, 24 nt, Artificial Sequence
  Targeting Domain
aaggcuguagcgaugcucacuggg

SEQ ID NO: 1781 - RNA, 18 nt, Artificial Sequence
  Targeting Domain
ccugcaagacagagaugg

SEQ ID NO: 1782 - RNA, 19 nt, Artificial Sequence
  Targeting Domain
uccugcaagacagagaugg

SEQ ID NO: 1783 - RNA, 20 nt, Artificial Sequence
  Targeting Domain
guccugcaagacagagaugg

SEQ ID NO: 1784 - RNA, 21 nt, Artificial Sequence
  Targeting Domain
uguccugcaagacagagaugg

SEQ ID NO: 1785 - RNA, 22 nt, Artificial Sequence
  Targeting Domain
uuguccugcaagacagagaugg

SEQ ID NO: 1786 - RNA, 23 nt, Artificial Sequence
  Targeting Domain
auuguccugcaagacagagaugg

SEQ ID NO: 1787 - RNA, 24 nt, Artificial Sequence
  Targeting Domain
cauuguccugcaagacagagaugg

SEQ ID NO: 1788 - RNA, 18 nt, Artificial Sequence
  Targeting Domain
agcuggcugucuggcugg

SEQ ID NO: 1789 - RNA, 19 nt, Artificial Sequence
  Targeting Domain
gagcuggcugucuggcugg

SEQ ID NO: 1790 - RNA, 20 nt, Artificial Sequence
  Targeting Domain
ggagcuggcugucuggcugg

SEQ ID NO: 1791 - RNA, 21 nt, Artificial Sequence
  Targeting Domain
uggagcuggcugucuggcugg

SEQ ID NO: 1792 - RNA, 22 nt, Artificial Sequence
  Targeting Domain
cuggagcuggcugucuggcugg

SEQ ID NO: 1793 - RNA, 23 nt, Artificial Sequence
  Targeting Domain
gcuggagcuggcugucuggcugg

SEQ ID NO: 1794 - RNA, 24 nt, Artificial Sequence
  Targeting Domain
agcuggagcuggcugucuggcugg

SEQ ID NO: 1795 - RNA, 18 nt, Artificial Sequence
  Targeting Domain
ugggugauccugaucaug

SEQ ID NO: 1796 - RNA, 19 nt, Artificial Sequence
  Targeting Domain
uugggugauccugaucaug

SEQ ID NO: 1797 - RNA, 20 nt, Artificial Sequence
  Targeting Domain
guugggugauccugaucaug

SEQ ID NO: 1798 - RNA, 21 nt, Artificial Sequence
  Targeting Domain
gguugggugauccugaucaug

SEQ ID NO: 1799 - RNA, 22 nt, Artificial Sequence
  Targeting Domain
agguugggugauccugaucaug

SEQ ID NO: 1800 - RNA, 23 nt, Artificial Sequence
  Targeting Domain
aagguugggugauccugaucaug

SEQ ID NO: 1801 - RNA, 24 nt, Artificial Sequence
  Targeting Domain
gaagguugggugauccugaucaug

SEQ ID NO: 1802 - RNA, 18 nt, Artificial Sequence
  Targeting Domain
uccugcaagacagagaug

SEQ ID NO: 1803 - RNA, 19 nt, Artificial Sequence
  Targeting Domain
guccugcaagacagagaug

SEQ ID NO: 1804 - RNA, 21 nt, Artificial Sequence
  Targeting Domain
uuguccugcaagacagagaug

SEQ ID NO: 1805 - RNA, 22 nt, Artificial Sequence
  Targeting Domain
auuguccugcaagacagagaug

SEQ ID NO: 1806 - RNA, 23 nt, Artificial Sequence
  Targeting Domain
cauuguccugcaagacagagaug

SEQ ID NO: 1807 - RNA, 24 nt, Artificial Sequence
  Targeting Domain
gcauuguccugcaagacagagaug

SEQ ID NO: 1808 - RNA, 18 nt, Artificial Sequence
  Targeting Domain
cuguagcgaugcucacug

SEQ ID NO: 1809 - RNA, 19 nt, Artificial Sequence
  Targeting Domain
gcuguagcgaugcucacug

SEQ ID NO: 1810 - RNA, 21 nt, Artificial Sequence
  Targeting Domain
aggcuguagcgaugcucacug

SEQ ID NO: 1811 - RNA, 22 nt, Artificial Sequence
  Targeting Domain
aaggcuguagcgaugcucacug

SEQ ID NO: 1812 - RNA, 23 nt, Artificial Sequence
  Targeting Domain
aaaggcuguagcgaugcucacug

SEQ ID NO: 1813 - RNA, 24 nt, Artificial Sequence
  Targeting Domain
caaaggcuguagcgaugcucacug

SEQ ID NO: 1814 - RNA, 18 nt, Artificial Sequence
  Targeting Domain
agcuucaggcccucgcug

SEQ ID NO: 1815 - RNA, 19 nt, Artificial Sequence
  Targeting Domain
uagcuucaggcccucgcug

SEQ ID NO: 1816 - RNA, 21 nt, Artificial Sequence
  Targeting Domain
acuagcuucaggcccucgcug

SEQ ID NO: 1817 - RNA, 22 nt, Artificial Sequence
  Targeting Domain
cacuagcuucaggcccucgcug

SEQ ID NO: 1818 - RNA, 23 nt, Artificial Sequence
  Targeting Domain
ccacuagcuucaggcccucgcug

SEQ ID NO: 1819 - RNA, 24 nt, Artificial Sequence
  Targeting Domain
uccacuagcuucaggcccucgcug

SEQ ID NO: 1820 - RNA, 18 nt, Artificial Sequence
  Targeting Domain
aagaagauauuggugcug

SEQ ID NO: 1821 - RNA, 19 nt, Artificial Sequence
  Targeting Domain
gaagaagauauuggugcug

SEQ ID NO: 1822 - RNA, 20 nt, Artificial Sequence
  Targeting Domain
agaagaagauauuggugcug

SEQ ID NO: 1823 - RNA, 21 nt, Artificial Sequence
  Targeting Domain
gagaagaagauauuggugcug

SEQ ID NO: 1824 - RNA, 22 nt, Artificial Sequence
  Targeting Domain
ggagaagaagauauuggugcug

SEQ ID NO: 1825 - RNA, 23 nt, Artificial Sequence
  Targeting Domain
gggagaagaagauauuggugcug

SEQ ID NO: 1826 - RNA, 24 nt, Artificial Sequence
  Targeting Domain
ggggagaagaagauauuggugcug

SEQ ID NO: 1827 - RNA, 18 nt, Artificial Sequence
  Targeting Domain
agguugggggugaucuug

SEQ ID NO: 1828 - RNA, 19 nt, Artificial Sequence
  Targeting Domain
cagguugggggugaucuug

SEQ ID NO: 1829 - RNA, 20 nt, Artificial Sequence
  Targeting Domain
ccagguugggggugaucuug

SEQ ID NO: 1830 - RNA, 21 nt, Artificial Sequence
  Targeting Domain
gccagguugggggugaucuug

SEQ ID NO: 1831 - RNA, 22 nt, Artificial Sequence
  Targeting Domain
agccagguugggggugaucuug

SEQ ID NO: 1832 - RNA, 23 nt, Artificial Sequence
  Targeting Domain
cagccagguugggggugaucuug

SEQ ID NO: 1833 - RNA, 24 nt, Artificial Sequence
  Targeting Domain
ucagccagguugggggugaucuug

SEQ ID NO: 1834 - RNA, 18 nt, Artificial Sequence
  Targeting Domain
guccugcaagacagagau

SEQ ID NO: 1835 - RNA, 19 nt, Artificial Sequence
  Targeting Domain
uguccugcaagacagagau

SEQ ID NO: 1836 - RNA, 21 nt, Artificial Sequence
  Targeting Domain
auuguccugcaagacagagau

SEQ ID NO: 1837 - RNA, 22 nt, Artificial Sequence
  Targeting Domain
cauuguccugcaagacagagau

SEQ ID NO: 1838 - RNA, 23 nt, Artificial Sequence
  Targeting Domain
gcauuguccugcaagacagagau

SEQ ID NO: 1839 - RNA, 24 nt, Artificial Sequence
  Targeting Domain
ggcauuguccugcaagacagagau

SEQ ID NO: 1840 - RNA, 18 nt, Artificial Sequence
  Targeting Domain
cuggaagccuucauggau

SEQ ID NO: 1841 - RNA, 19 nt, Artificial Sequence
  Targeting Domain
ccuggaagccuucauggau

SEQ ID NO: 1842 - RNA, 20 nt, Artificial Sequence
  Targeting Domain
uccuggaagccuucauggau

SEQ ID NO: 1843 - RNA, 21 nt, Artificial Sequence
  Targeting Domain
uuccuggaagccuucauggau

SEQ ID NO: 1844 - RNA, 22 nt, Artificial Sequence
  Targeting Domain
guuccuggaagccuucauggau

SEQ ID NO: 1845 - RNA, 23 nt, Artificial Sequence
  Targeting Domain
aguuccuggaagccuucauggau

SEQ ID NO: 1846 - RNA, 24 nt, Artificial Sequence
  Targeting Domain
gaguuccuggaagccuucauggau

SEQ ID NO: 1847 - RNA, 18 nt, Artificial Sequence
  Targeting Domain
gcuguagcgaugcucacu

SEQ ID NO: 1848 - RNA, 19 nt, Artificial Sequence
  Targeting Domain
ggcuguagcgaugcucacu

SEQ ID NO: 1849 - RNA, 21 nt, Artificial Sequence
  Targeting Domain
aaggcuguagcgaugcucacu

SEQ ID NO: 1850 - RNA, 22 nt, Artificial Sequence
  Targeting Domain
aaaggcuguagcgaugcucacu

SEQ ID NO: 1851 - RNA, 23 nt, Artificial Sequence
  Targeting Domain
caaaggcuguagcgaugcucacu

SEQ ID NO: 1852 - RNA, 24 nt, Artificial Sequence
  Targeting Domain
gcaaaggcuguagcgaugcucacu

SEQ ID NO: 1853 - RNA, 18 nt, Artificial Sequence
  Targeting Domain
cuucauggaucugagccu

SEQ ID NO: 1854 - RNA, 19 nt, Artificial Sequence
  Targeting Domain
ccuucauggaucugagccu

SEQ ID NO: 1855 - RNA, 20 nt, Artificial Sequence
  Targeting Domain
gccuucauggaucugagccu

SEQ ID NO: 1856 - RNA, 21 nt, Artificial Sequence
  Targeting Domain
agccuucauggaucugagccu

SEQ ID NO: 1857 - RNA, 22 nt, Artificial Sequence
  Targeting Domain
aagccuucauggaucugagccu

SEQ ID NO: 1858 - RNA, 23 nt, Artificial Sequence
  Targeting Domain
gaagccuucauggaucugagccu

SEQ ID NO: 1859 - RNA, 24 nt, Artificial Sequence
  Targeting Domain
ggaagccuucauggaucugagccu

SEQ ID NO: 1860 - RNA, 18 nt, Artificial Sequence
  Targeting Domain
uagcuucaggcccucgcu

SEQ ID NO: 1861 - RNA, 19 nt, Artificial Sequence
  Targeting Domain
cuagcuucaggcccucgcu

SEQ ID NO: 1862 - RNA, 20 nt, Artificial Sequence
  Targeting Domain
acuagcuucaggcccucgcu

SEQ ID NO: 1863 - RNA, 21 nt, Artificial Sequence
  Targeting Domain
cacuagcuucaggcccucgcu

SEQ ID NO: 1864 - RNA, 22 nt, Artificial Sequence
  Targeting Domain
ccacuagcuucaggcccucgcu

SEQ ID NO: 1865 - RNA, 23 nt, Artificial Sequence
  Targeting Domain
uccacuagcuucaggcccucgcu

SEQ ID NO: 1866 - RNA, 24 nt, Artificial Sequence
  Targeting Domain
auccacuagcuucaggcccucgcu

SEQ ID NO: 1867 - RNA, 18 nt, Artificial Sequence
  Targeting Domain
aggcgaacucagccaggu

SEQ ID NO: 1868 - RNA, 19 nt, Artificial Sequence
  Targeting Domain
aaggcgaacucagccaggu

SEQ ID NO: 1869 - RNA, 21 nt, Artificial Sequence
  Targeting Domain
ugaaggcgaacucagccaggu

SEQ ID NO: 1870 - RNA, 22 nt, Artificial Sequence
  Targeting Domain
cugaaggcgaacucagccaggu

SEQ ID NO: 1871 - RNA, 23 nt, Artificial Sequence
  Targeting Domain
gcugaaggcgaacucagccaggu

SEQ ID NO: 1872 - RNA, 24 nt, Artificial Sequence
  Targeting Domain
ggcugaaggcgaacucagccaggu

SEQ ID NO: 1873 - RNA, 18 nt, Artificial Sequence
  Targeting Domain
gucuggcugguugagggu

SEQ ID NO: 1874 - RNA, 19 nt, Artificial Sequence
  Targeting Domain
ugucuggcugguugagggu

SEQ ID NO: 1875 - RNA, 20 nt, Artificial Sequence
  Targeting Domain
cugucuggcugguugagggu

SEQ ID NO: 1876 - RNA, 21 nt, Artificial Sequence
  Targeting Domain
gcugucuggcugguugagggu

SEQ ID NO: 1877 - RNA, 22 nt, Artificial Sequence
  Targeting Domain
ggcugucuggcugguugagggu

SEQ ID NO: 1878 - RNA, 23 nt, Artificial Sequence
  Targeting Domain
uggcugucuggcugguugagggu

SEQ ID NO: 1879 - RNA, 24 nt, Artificial Sequence
  Targeting Domain
cuggcugucuggcugguugagggu

SEQ ID NO: 1880 - RNA, 18 nt, Artificial Sequence
  Targeting Domain
gugggauguaucugucuu

SEQ ID NO: 1881 - RNA, 19 nt, Artificial Sequence
  Targeting Domain
ggugggauguaucugucuu

SEQ ID NO: 1882 - RNA, 20 nt, Artificial Sequence
  Targeting Domain
uggugggauguaucugucuu

SEQ ID NO: 1883 - RNA, 21 nt, Artificial Sequence
  Targeting Domain
auggugggauguaucugucuu

SEQ ID NO: 1884 - RNA, 22 nt, Artificial Sequence
  Targeting Domain
cauggugggauguaucugucuu

SEQ ID NO: 1885 - RNA, 23 nt, Artificial Sequence
  Targeting Domain
ucauggugggauguaucugucuu

SEQ ID NO: 1886 - RNA, 24 nt, Artificial Sequence
  Targeting Domain
aucauggugggauguaucugucuu

SEQ ID NO: 1887 - RNA, 18 nt, Artificial Sequence
  Targeting Domain
guggagaaggguacucaa

SEQ ID NO: 1888 - RNA, 19 nt, Artificial Sequence
  Targeting Domain
cguggagaaggguacucaa

SEQ ID NO: 1889 - RNA, 21 nt, Artificial Sequence
  Targeting Domain
uacguggagaaggguacucaa

SEQ ID NO: 1890 - RNA, 22 nt, Artificial Sequence
  Targeting Domain
uuacguggagaaggguacucaa

SEQ ID NO: 1891 - RNA, 23 nt, Artificial Sequence
  Targeting Domain
auuacguggagaaggguacucaa

SEQ ID NO: 1892 - RNA, 24 nt, Artificial Sequence
  Targeting Domain
gauuacguggagaaggguacucaa

SEQ ID NO: 1893 - RNA, 18 nt, Artificial Sequence
  Targeting Domain
cugucaacuucggggaca

SEQ ID NO: 1894 - RNA, 19 nt, Artificial Sequence
  Targeting Domain
acugucaacuucggggaca

SEQ ID NO: 1895 - RNA, 20 nt, Artificial Sequence
  Targeting Domain
cacugucaacuucggggaca

SEQ ID NO: 1896 - RNA, 21 nt, Artificial Sequence
  Targeting Domain
ucacugucaacuucggggaca

SEQ ID NO: 1897 - RNA, 22 nt, Artificial Sequence
  Targeting Domain
uucacugucaacuucggggaca

SEQ ID NO: 1898 - RNA, 23 nt, Artificial Sequence
  Targeting Domain
cuucacugucaacuucggggaca

SEQ ID NO: 1899 - RNA, 24 nt, Artificial Sequence
  Targeting Domain
ccuucacugucaacuucggggaca

SEQ ID NO: 1900 - RNA, 18 nt, Artificial Sequence
  Targeting Domain
ccuggcugaggaucccca

SEQ ID NO: 1901 - RNA, 19 nt, Artificial Sequence
  Targeting Domain
cccuggcugaggaucccca

SEQ ID NO: 1902 - RNA, 21 nt, Artificial Sequence
  Targeting Domain
cucccuggcugaggaucccca

SEQ ID NO: 1903 - RNA, 22 nt, Artificial Sequence
  Targeting Domain
ucucccuggcugaggaucccca

SEQ ID NO: 1904 - RNA, 23 nt, Artificial Sequence
  Targeting Domain
gucucccuggcugaggaucccca

SEQ ID NO: 1905 - RNA, 24 nt, Artificial Sequence
  Targeting Domain
ugucucccuggcugaggaucccca

SEQ ID NO: 1906 - RNA, 18 nt, Artificial Sequence
  Targeting Domain
aauaucuucuucucccca

SEQ ID NO: 1907 - RNA, 19 nt, Artificial Sequence
  Targeting Domain
caauaucuucuucucccca

SEQ ID NO: 1908 - RNA, 20 nt, Artificial Sequence
  Targeting Domain
ccaauaucuucuucucccca

SEQ ID NO: 1909 - RNA, 21 nt, Artificial Sequence
  Targeting Domain
accaauaucuucuucucccca

SEQ ID NO: 1910 - RNA, 22 nt, Artificial Sequence
  Targeting Domain
caccaauaucuucuucucccca

SEQ ID NO: 1911 - RNA, 23 nt, Artificial Sequence
  Targeting Domain
gcaccaauaucuucuucucccca

SEQ ID NO: 1912 - RNA, 24 nt, Artificial Sequence
  Targeting Domain
agcaccaauaucuucuucucccca

SEQ ID NO: 1913 - RNA, 18 nt, Artificial Sequence
  Targeting Domain
cguggagaaggguacuca

SEQ ID NO: 1914 - RNA, 19 nt, Artificial Sequence
  Targeting Domain
acguggagaaggguacuca

SEQ ID NO: 1915 - RNA, 21 nt, Artificial Sequence
  Targeting Domain
uuacguggagaaggguacuca

SEQ ID NO: 1916 - RNA, 22 nt, Artificial Sequence
  Targeting Domain
auuacguggagaaggguacuca

SEQ ID NO: 1917 - RNA, 23 nt, Artificial Sequence
  Targeting Domain
gauuacguggagaaggguacuca

SEQ ID NO: 1918 - RNA, 24 nt, Artificial Sequence
  Targeting Domain
cgauuacguggagaaggguacuca

SEQ ID NO: 1919 - RNA, 18 nt, Artificial Sequence
  Targeting Domain
gccugaauuucaaccuca

SEQ ID NO: 1920 - RNA, 19 nt, Artificial Sequence
  Targeting Domain
ggccugaauuucaaccuca

SEQ ID NO: 1921 - RNA, 20 nt, Artificial Sequence
  Targeting Domain
gggccugaauuucaaccuca

SEQ ID NO: 1922 - RNA, 21 nt, Artificial Sequence
  Targeting Domain
agggccugaauuucaaccuca

SEQ ID NO: 1923 - RNA, 22 nt, Artificial Sequence
  Targeting Domain
gagggccugaauuucaaccuca

SEQ ID NO: 1924 - RNA, 23 nt, Artificial Sequence
  Targeting Domain
ggagggccugaauuucaaccuca

SEQ ID NO: 1925 - RNA, 24 nt, Artificial Sequence
  Targeting Domain
uggagggccugaauuucaaccuca

SEQ ID NO: 1926 - RNA, 18 nt, Artificial Sequence
  Targeting Domain
gcaauggccuguuccuca

SEQ ID NO: 1927 - RNA, 19 nt, Artificial Sequence
  Targeting Domain
ggcaauggccuguuccuca

SEQ ID NO: 1928 - RNA, 20 nt, Artificial Sequence
  Targeting Domain
cggcaauggccuguuccuca

SEQ ID NO: 1929 - RNA, 21 nt, Artificial Sequence
  Targeting Domain
ccggcaauggccuguuccuca

SEQ ID NO: 1930 - RNA, 22 nt, Artificial Sequence
  Targeting Domain
accggcaauggccuguuccuca

SEQ ID NO: 1931 - RNA, 23 nt, Artificial Sequence
  Targeting Domain
caccggcaauggccuguuccuca

SEQ ID NO: 1932 - RNA, 24 nt, Artificial Sequence
  Targeting Domain
ccaccggcaauggccuguuccuca

SEQ ID NO: 1933 - RNA, 18 nt, Artificial Sequence
  Targeting Domain
aaauuguggauuugguca

SEQ ID NO: 1934 - RNA, 19 nt, Artificial Sequence
  Targeting Domain
aaaauuguggauuugguca

SEQ ID NO: 1935 - RNA, 20 nt, Artificial Sequence
  Targeting Domain
gaaaauuguggauuugguca

SEQ ID NO: 1936 - RNA, 21 nt, Artificial Sequence
  Targeting Domain
ggaaaauuguggauuugguca

SEQ ID NO: 1937 - RNA, 22 nt, Artificial Sequence
  Targeting Domain
gggaaaauuguggauuugguca

SEQ ID NO: 1938 - RNA, 23 nt, Artificial Sequence
  Targeting Domain
agggaaaauuguggauuugguca

SEQ ID NO: 1939 - RNA, 24 nt, Artificial Sequence
  Targeting Domain
aagggaaaauuguggauuugguca

SEQ ID NO: 1940 - RNA, 18 nt, Artificial Sequence
  Targeting Domain
uuuggucaaggagcuuga

SEQ ID NO: 1941 - RNA, 19 nt, Artificial Sequence
  Targeting Domain
auuuggucaaggagcuuga

SEQ ID NO: 1942 - RNA, 20 nt, Artificial Sequence
  Targeting Domain
gauuuggucaaggagcuuga

SEQ ID NO: 1943 - RNA, 21 nt, Artificial Sequence
  Targeting Domain
ggauuuggucaaggagcuuga

SEQ ID NO: 1944 - RNA, 22 nt, Artificial Sequence
  Targeting Domain
uggauuuggucaaggagcuuga

SEQ ID NO: 1945 - RNA, 23 nt, Artificial Sequence
  Targeting Domain
guggauuuggucaaggagcuuga

SEQ ID NO: 1946 - RNA, 24 nt, Artificial Sequence
  Targeting Domain
uguggauuuggucaaggagcuuga

SEQ ID NO: 1947 - RNA, 18 nt, Artificial Sequence
  Targeting Domain
aaacagaucaacgauuac

SEQ ID NO: 1948 - RNA, 19 nt, Artificial Sequence
  Targeting Domain
gaaacagaucaacgauuac

SEQ ID NO: 1949 - RNA, 20 nt, Artificial Sequence
  Targeting Domain
agaaacagaucaacgauuac

SEQ ID NO: 1950 - RNA, 21 nt, Artificial Sequence
  Targeting Domain
aagaaacagaucaacgauuac

SEQ ID NO: 1951 - RNA, 22 nt, Artificial Sequence
  Targeting Domain
caagaaacagaucaacgauuac

SEQ ID NO: 1952 - RNA, 23 nt, Artificial Sequence
  Targeting Domain
ccaagaaacagaucaacgauuac

SEQ ID NO: 1953 - RNA, 24 nt, Artificial Sequence
  Targeting Domain
gccaagaaacagaucaacgauuac

SEQ ID NO: 1954 - RNA, 18 nt, Artificial Sequence
  Targeting Domain
cccuggcugaggaucccc

SEQ ID NO: 1955 - RNA, 19 nt, Artificial Sequence
  Targeting Domain
ucccuggcugaggaucccc

SEQ ID NO: 1956 - RNA, 21 nt, Artificial Sequence
  Targeting Domain
ucucccuggcugaggaucccc

SEQ ID NO: 1957 - RNA, 22 nt, Artificial Sequence
  Targeting Domain
gucucccuggcugaggaucccc

SEQ ID NO: 1958 - RNA, 23 nt, Artificial Sequence
  Targeting Domain
ugucucccuggcugaggaucccc

SEQ ID NO: 1959 - RNA, 24 nt, Artificial Sequence
  Targeting Domain
cugucucccuggcugaggaucccc

SEQ ID NO: 1960 - RNA, 18 nt, Artificial Sequence
  Targeting Domain
ucccuggcugaggauccc

SEQ ID NO: 1961 - RNA, 19 nt, Artificial Sequence
  Targeting Domain
cucccuggcugaggauccc

SEQ ID NO: 1962 - RNA, 20 nt, Artificial Sequence
  Targeting Domain
ucucccuggcugaggauccc

SEQ ID NO: 1963 - RNA, 21 nt, Artificial Sequence
  Targeting Domain
gucucccuggcugaggauccc

SEQ ID NO: 1964 - RNA, 22 nt, Artificial Sequence
  Targeting Domain
ugucucccuggcugaggauccc

SEQ ID NO: 1965 - RNA, 23 nt, Artificial Sequence
  Targeting Domain
cugucucccuggcugaggauccc

SEQ ID NO: 1966 - RNA, 24 nt, Artificial Sequence
  Targeting Domain
ccugucucccuggcugaggauccc

SEQ ID NO: 1967 - RNA, 18 nt, Artificial Sequence
  Targeting Domain
ccuuugcaaugcucuccc

SEQ ID NO: 1968 - RNA, 19 nt, Artificial Sequence
  Targeting Domain
gccuuugcaaugcucuccc

SEQ ID NO: 1969 - RNA, 21 nt, Artificial Sequence
  Targeting Domain
cagccuuugcaaugcucuccc

SEQ ID NO: 1970 - RNA, 22 nt, Artificial Sequence
  Targeting Domain
acagccuuugcaaugcucuccc

SEQ ID NO: 1971 - RNA, 23 nt, Artificial Sequence
  Targeting Domain
uacagccuuugcaaugcucuccc

SEQ ID NO: 1972 - RNA, 24 nt, Artificial Sequence
  Targeting Domain
cuacagccuuugcaaugcucuccc

SEQ ID NO: 1973 - RNA, 18 nt, Artificial Sequence
  Targeting Domain
ggggacaccgaagaggcc

SEQ ID NO: 1974 - RNA, 19 nt, Artificial Sequence
  Targeting Domain
cggggacaccgaagaggcc

SEQ ID NO: 1975 - RNA, 20 nt, Artificial Sequence
  Targeting Domain
ucggggacaccgaagaggcc

SEQ ID NO: 1976 - RNA, 21 nt, Artificial Sequence
  Targeting Domain
uucggggacaccgaagaggcc

SEQ ID NO: 1977 - RNA, 22 nt, Artificial Sequence
  Targeting Domain
cuucggggacaccgaagaggcc

SEQ ID NO: 1978 - RNA, 23 nt, Artificial Sequence
  Targeting Domain
acuucggggacaccgaagaggcc

SEQ ID NO: 1979 - RNA, 24 nt, Artificial Sequence
  Targeting Domain
aacuucggggacaccgaagaggcc

SEQ ID NO: 1980 - RNA, 18 nt, Artificial Sequence
  Targeting Domain
ccccagggagaugcugcc

SEQ ID NO: 1981 - RNA, 19 nt, Artificial Sequence
  Targeting Domain
uccccagggagaugcugcc

SEQ ID NO: 1982 - RNA, 20 nt, Artificial Sequence
  Targeting Domain
auccccagggagaugcugcc

SEQ ID NO: 1983 - RNA, 21 nt, Artificial Sequence
  Targeting Domain
gauccccagggagaugcugcc

SEQ ID NO: 1984 - RNA, 22 nt, Artificial Sequence
  Targeting Domain
ggauccccagggagaugcugcc

SEQ ID NO: 1985 - RNA, 23 nt, Artificial Sequence
  Targeting Domain
aggauccccagggagaugcugcc

SEQ ID NO: 1986 - RNA, 24 nt, Artificial Sequence
  Targeting Domain
gaggauccccagggagaugcugcc

SEQ ID NO: 1987 - RNA, 18 nt, Artificial Sequence
  Targeting Domain
acacucacgaugaaaucc

SEQ ID NO: 1988 - RNA, 19 nt, Artificial Sequence
  Targeting Domain
gacacucacgaugaaaucc

SEQ ID NO: 1989 - RNA, 21 nt, Artificial Sequence
  Targeting Domain
cugacacucacgaugaaaucc

SEQ ID NO: 1990 - RNA, 22 nt, Artificial Sequence
  Targeting Domain
gcugacacucacgaugaaaucc

SEQ ID NO: 1991 - RNA, 23 nt, Artificial Sequence
  Targeting Domain
ggcugacacucacgaugaaaucc

SEQ ID NO: 1992 - RNA, 24 nt, Artificial Sequence
  Targeting Domain
aggcugacacucacgaugaaaucc

SEQ ID NO: 1993 - RNA, 18 nt, Artificial Sequence
  Targeting Domain
uuccggaggcucagaucc

SEQ ID NO: 1994 - RNA, 19 nt, Artificial Sequence
  Targeting Domain
auuccggaggcucagaucc

SEQ ID NO: 1995 - RNA, 20 nt, Artificial Sequence
  Targeting Domain
gauuccggaggcucagaucc

SEQ ID NO: 1996 - RNA, 21 nt, Artificial Sequence
  Targeting Domain
agauuccggaggcucagaucc

SEQ ID NO: 1997 - RNA, 22 nt, Artificial Sequence
  Targeting Domain
gagauuccggaggcucagaucc

SEQ ID NO: 1998 - RNA, 23 nt, Artificial Sequence
  Targeting Domain
ggagauuccggaggcucagaucc

SEQ ID NO: 1999 - RNA, 24 nt, Artificial Sequence
  Targeting Domain
cggagauuccggaggcucagaucc

SEQ ID NO: 2000 - RNA, 18 nt, Artificial Sequence
  Targeting Domain
gccuuugcaaugcucucc

SEQ ID NO: 2001 - RNA, 19 nt, Artificial Sequence
  Targeting Domain
agccuuugcaaugcucucc

SEQ ID NO: 2002 - RNA, 20 nt, Artificial Sequence
  Targeting Domain
cagccuuugcaaugcucucc

SEQ ID NO: 2003 - RNA, 21 nt, Artificial Sequence
  Targeting Domain
acagccuuugcaaugcucucc

SEQ ID NO: 2004 - RNA, 22 nt, Artificial Sequence
  Targeting Domain
uacagccuuugcaaugcucucc

SEQ ID NO: 2005 - RNA, 23 nt, Artificial Sequence
  Targeting Domain
cuacagccuuugcaaugcucucc

SEQ ID NO: 2006 - RNA, 24 nt, Artificial Sequence
  Targeting Domain
gcuacagccuuugcaaugcucucc

SEQ ID NO: 2007 - RNA, 18 nt, Artificial Sequence
  Targeting Domain
agauccaugaaggcuucc

SEQ ID NO: 2008 - RNA, 19 nt, Artificial Sequence
  Targeting Domain
cagauccaugaaggcuucc

SEQ ID NO: 2009 - RNA, 21 nt, Artificial Sequence
  Targeting Domain
cucagauccaugaaggcuucc

SEQ ID NO: 2010 - RNA, 22 nt, Artificial Sequence
  Targeting Domain
gcucagauccaugaaggcuucc

SEQ ID NO: 2011 - RNA, 23 nt, Artificial Sequence
  Targeting Domain
ggcucagauccaugaaggcuucc

SEQ ID NO: 2012 - RNA, 24 nt, Artificial Sequence
  Targeting Domain
aggcucagauccaugaaggcuucc

SEQ ID NO: 2013 - RNA, 18 nt, Artificial Sequence
  Targeting Domain
uaagguugcucaaccagc

SEQ ID NO: 2014 - RNA, 19 nt, Artificial Sequence
  Targeting Domain
guaagguugcucaaccagc

SEQ ID NO: 2015 - RNA, 20 nt, Artificial Sequence
  Targeting Domain
gguaagguugcucaaccagc

SEQ ID NO: 2016 - RNA, 21 nt, Artificial Sequence
  Targeting Domain
agguaagguugcucaaccagc

SEQ ID NO: 2017 - RNA, 22 nt, Artificial Sequence
  Targeting Domain
aagguaagguugcucaaccagc

SEQ ID NO: 2018 - RNA, 23 nt, Artificial Sequence
  Targeting Domain
aaagguaagguugcucaaccagc

SEQ ID NO: 2019 - RNA, 24 nt, Artificial Sequence
  Targeting Domain
uaaagguaagguugcucaaccagc

SEQ ID NO: 2020 - RNA, 18 nt, Artificial Sequence
  Targeting Domain
aauggccuguuccucagc

SEQ ID NO: 2021 - RNA, 19 nt, Artificial Sequence
  Targeting Domain
caauggccuguuccucagc

SEQ ID NO: 2022 - RNA, 20 nt, Artificial Sequence
  Targeting Domain
gcaauggccuguuccucagc

SEQ ID NO: 2023 - RNA, 21 nt, Artificial Sequence
  Targeting Domain
ggcaauggccuguuccucagc

SEQ ID NO: 2024 - RNA, 22 nt, Artificial Sequence
  Targeting Domain
cggcaauggccuguuccucagc

SEQ ID NO: 2025 - RNA, 23 nt, Artificial Sequence
  Targeting Domain
ccggcaauggccuguuccucagc

SEQ ID NO: 2026 - RNA, 24 nt, Artificial Sequence
  Targeting Domain
accggcaauggccuguuccucagc

SEQ ID NO: 2027 - RNA, 18 nt, Artificial Sequence
  Targeting Domain
cuguuccucagcgagggc

SEQ ID NO: 2028 - RNA, 19 nt, Artificial Sequence
  Targeting Domain
ccuguuccucagcgagggc

SEQ ID NO: 2029 - RNA, 20 nt, Artificial Sequence
  Targeting Domain
gccuguuccucagcgagggc

SEQ ID NO: 2030 - RNA, 21 nt, Artificial Sequence
  Targeting Domain
ggccuguuccucagcgagggc

SEQ ID NO: 2031 - RNA, 22 nt, Artificial Sequence
  Targeting Domain
uggccuguuccucagcgagggc

SEQ ID NO: 2032 - RNA, 23 nt, Artificial Sequence
  Targeting Domain
auggccuguuccucagcgagggc

SEQ ID NO: 2033 - RNA, 24 nt, Artificial Sequence
  Targeting Domain
aauggccuguuccucagcgagggc

SEQ ID NO: 2034 - RNA, 18 nt, Artificial Sequence
  Targeting Domain
gacacucacgaugaaauc

SEQ ID NO: 2035 - RNA, 19 nt, Artificial Sequence
  Targeting Domain
ugacacucacgaugaaauc

SEQ ID NO: 2036 - RNA, 20 nt, Artificial Sequence
  Targeting Domain
cugacacucacgaugaaauc

SEQ ID NO: 2037 - RNA, 21 nt, Artificial Sequence
  Targeting Domain
gcugacacucacgaugaaauc

SEQ ID NO: 2038 - RNA, 22 nt, Artificial Sequence
  Targeting Domain
ggcugacacucacgaugaaauc

SEQ ID NO: 2039 - RNA, 23 nt, Artificial Sequence
  Targeting Domain
aggcugacacucacgaugaaauc

SEQ ID NO: 2040 - RNA, 24 nt, Artificial Sequence
  Targeting Domain
aaggcugacacucacgaugaaauc

SEQ ID NO: 2041 - RNA, 18 nt, Artificial Sequence
  Targeting Domain
acguggagaaggguacuc

SEQ ID NO: 2042 - RNA, 19 nt, Artificial Sequence
  Targeting Domain
uacguggagaaggguacuc

SEQ ID NO: 2043 - RNA, 20 nt, Artificial Sequence
  Targeting Domain
uuacguggagaaggguacuc

SEQ ID NO: 2044 - RNA, 21 nt, Artificial Sequence
  Targeting Domain
auuacguggagaaggguacuc

SEQ ID NO: 2045 - RNA, 22 nt, Artificial Sequence
  Targeting Domain
gauuacguggagaaggguacuc

SEQ ID NO: 2046 - RNA, 23 nt, Artificial Sequence
  Targeting Domain
cgauuacguggagaaggguacuc

SEQ ID NO: 2047 - RNA, 24 nt, Artificial Sequence
  Targeting Domain
acgauuacguggagaaggguacuc

SEQ ID NO: 2048 - RNA, 18 nt, Artificial Sequence
  Targeting Domain
ggccugaauuucaaccuc

SEQ ID NO: 2049 - RNA, 19 nt, Artificial Sequence
  Targeting Domain
gggccugaauuucaaccuc

SEQ ID NO: 2050 - RNA, 20 nt, Artificial Sequence
  Targeting Domain
agggccugaauuucaaccuc

SEQ ID NO: 2051 - RNA, 21 nt, Artificial Sequence
  Targeting Domain
gagggccugaauuucaaccuc

SEQ ID NO: 2052 - RNA, 22 nt, Artificial Sequence
  Targeting Domain
ggagggccugaauuucaaccuc

SEQ ID NO: 2053 - RNA, 23 nt, Artificial Sequence
  Targeting Domain
uggagggccugaauuucaaccuc

SEQ ID NO: 2054 - RNA, 24 nt, Artificial Sequence
  Targeting Domain
cuggagggccugaauuucaaccuc

SEQ ID NO: 2055 - RNA, 18 nt, Artificial Sequence
  Targeting Domain
aaugccgucuucugucuc

SEQ ID NO: 2056 - RNA, 19 nt, Artificial Sequence
  Targeting Domain
caaugccgucuucugucuc

SEQ ID NO: 2057 - RNA, 20 nt, Artificial Sequence
  Targeting Domain
acaaugccgucuucugucuc

SEQ ID NO: 2058 - RNA, 21 nt, Artificial Sequence
  Targeting Domain
gacaaugccgucuucugucuc

SEQ ID NO: 2059 - RNA, 22 nt, Artificial Sequence
  Targeting Domain
ggacaaugccgucuucugucuc

SEQ ID NO: 2060 - RNA, 23 nt, Artificial Sequence
  Targeting Domain
aggacaaugccgucuucugucuc

SEQ ID NO: 2061 - RNA, 24 nt, Artificial Sequence
  Targeting Domain
caggacaaugccgucuucugucuc

SEQ ID NO: 2062 - RNA, 18 nt, Artificial Sequence
  Targeting Domain
aaaauuguggauuugguc

SEQ ID NO: 2063 - RNA, 19 nt, Artificial Sequence
  Targeting Domain
gaaaauuguggauuugguc

SEQ ID NO: 2064 - RNA, 20 nt, Artificial Sequence
  Targeting Domain
ggaaaauuguggauuugguc

SEQ ID NO: 2065 - RNA, 21 nt, Artificial Sequence
  Targeting Domain
gggaaaauuguggauuugguc

SEQ ID NO: 2066 - RNA, 22 nt, Artificial Sequence
  Targeting Domain
agggaaaauuguggauuugguc

SEQ ID NO: 2067 - RNA, 23 nt, Artificial Sequence
  Targeting Domain
aagggaaaauuguggauuugguc

SEQ ID NO: 2068 - RNA, 24 nt, Artificial Sequence
  Targeting Domain
caagggaaaauuguggauuugguc

SEQ ID NO: 2069 - RNA, 18 nt, Artificial Sequence
  Targeting Domain
ucaaccucacggagauuc

SEQ ID NO: 2070 - RNA, 19 nt, Artificial Sequence
  Targeting Domain
uucaaccucacggagauuc

SEQ ID NO: 2071 - RNA, 21 nt, Artificial Sequence
  Targeting Domain
auuucaaccucacggagauuc

SEQ ID NO: 2072 - RNA, 22 nt, Artificial Sequence
  Targeting Domain
aauuucaaccucacggagauuc

SEQ ID NO: 2073 - RNA, 23 nt, Artificial Sequence
  Targeting Domain
gaauuucaaccucacggagauuc

SEQ ID NO: 2074 - RNA, 24 nt, Artificial Sequence
  Targeting Domain
ugaauuucaaccucacggagauuc

SEQ ID NO: 2075 - RNA, 18 nt, Artificial Sequence
  Targeting Domain
gccuucacugucaacuuc

SEQ ID NO: 2076 - RNA, 19 nt, Artificial Sequence
  Targeting Domain
agccuucacugucaacuuc

SEQ ID NO: 2077 - RNA, 21 nt, Artificial Sequence
  Targeting Domain
gaagccuucacugucaacuuc

SEQ ID NO: 2078 - RNA, 22 nt, Artificial Sequence
  Targeting Domain
agaagccuucacugucaacuuc

SEQ ID NO: 2079 - RNA, 23 nt, Artificial Sequence
  Targeting Domain
cagaagccuucacugucaacuuc

SEQ ID NO: 2080 - RNA, 24 nt, Artificial Sequence
  Targeting Domain
ucagaagccuucacugucaacuuc

SEQ ID NO: 2081 - RNA, 18 nt, Artificial Sequence
  Targeting Domain
cagauccaugaaggcuuc

SEQ ID NO: 2082 - RNA, 19 nt, Artificial Sequence
  Targeting Domain
ucagauccaugaaggcuuc

SEQ ID NO: 2083 - RNA, 20 nt, Artificial Sequence
  Targeting Domain
cucagauccaugaaggcuuc

SEQ ID NO: 2084 - RNA, 21 nt, Artificial Sequence
  Targeting Domain
gcucagauccaugaaggcuuc

SEQ ID NO: 2085 - RNA, 22 nt, Artificial Sequence
  Targeting Domain
ggcucagauccaugaaggcuuc

SEQ ID NO: 2086 - RNA, 23 nt, Artificial Sequence
  Targeting Domain
aggcucagauccaugaaggcuuc

SEQ ID NO: 2087 - RNA, 24 nt, Artificial Sequence
  Targeting Domain
gaggcucagauccaugaaggcuuc

SEQ ID NO: 2088 - RNA, 18 nt, Artificial Sequence
  Targeting Domain
ccaaggcugacacucacg

SEQ ID NO: 2089 - RNA, 19 nt, Artificial Sequence
  Targeting Domain
accaaggcugacacucacg

SEQ ID NO: 2090 - RNA, 20 nt, Artificial Sequence
  Targeting Domain
gaccaaggcugacacucacg

SEQ ID NO: 2091 - RNA, 21 nt, Artificial Sequence
  Targeting Domain
ggaccaaggcugacacucacg

SEQ ID NO: 2092 - RNA, 22 nt, Artificial Sequence
  Targeting Domain
gggaccaaggcugacacucacg

SEQ ID NO: 2093 - RNA, 23 nt, Artificial Sequence
  Targeting Domain
ggggaccaaggcugacacucacg

SEQ ID NO: 2094 - RNA, 24 nt, Artificial Sequence
  Targeting Domain
uggggaccaaggcugacacucacg

SEQ ID NO: 2095 - RNA, 18 nt, Artificial Sequence
  Targeting Domain
aacagaucaacgauuacg

SEQ ID NO: 2096 - RNA, 19 nt, Artificial Sequence
  Targeting Domain
aaacagaucaacgauuacg

SEQ ID NO: 2097 - RNA, 21 nt, Artificial Sequence
  Targeting Domain
agaaacagaucaacgauuacg

SEQ ID NO: 2098 - RNA, 22 nt, Artificial Sequence
  Targeting Domain
aagaaacagaucaacgauuacg

SEQ ID NO: 2099 - RNA, 23 nt, Artificial Sequence
  Targeting Domain
caagaaacagaucaacgauuacg

SEQ ID NO: 2100 - RNA, 24 nt, Artificial Sequence
  Targeting Domain
ccaagaaacagaucaacgauuacg

SEQ ID NO: 2101 - RNA, 18 nt, Artificial Sequence
  Targeting Domain
ucaacuucggggacaccg

SEQ ID NO: 2102 - RNA, 19 nt, Artificial Sequence
  Targeting Domain
gucaacuucggggacaccg

SEQ ID NO: 2103 - RNA, 20 nt, Artificial Sequence
  Targeting Domain
ugucaacuucggggacaccg

SEQ ID NO: 2104 - RNA, 21 nt, Artificial Sequence
  Targeting Domain
cugucaacuucggggacaccg

SEQ ID NO: 2105 - RNA, 22 nt, Artificial Sequence
  Targeting Domain
acugucaacuucggggacaccg

SEQ ID NO: 2106 - RNA, 23 nt, Artificial Sequence
  Targeting Domain
cacugucaacuucggggacaccg

SEQ ID NO: 2107 - RNA, 24 nt, Artificial Sequence
  Targeting Domain
ucacugucaacuucggggacaccg

SEQ ID NO: 2108 - RNA, 18 nt, Artificial Sequence
  Targeting Domain
augccgucuucugucucg

SEQ ID NO: 2109 - RNA, 19 nt, Artificial Sequence
  Targeting Domain
aaugccgucuucugucucg

SEQ ID NO: 2110 - RNA, 21 nt, Artificial Sequence
  Targeting Domain
acaaugccgucuucugucucg

SEQ ID NO: 2111 - RNA, 22 nt, Artificial Sequence
  Targeting Domain
gacaaugccgucuucugucucg

SEQ ID NO: 2112 - RNA, 23 nt, Artificial Sequence
  Targeting Domain
ggacaaugccgucuucugucucg

SEQ ID NO: 2113 - RNA, 24 nt, Artificial Sequence
  Targeting Domain
aggacaaugccgucuucugucucg

SEQ ID NO: 2114 - RNA, 18 nt, Artificial Sequence
  Targeting Domain
uggucccugucucccugg

SEQ ID NO: 2115 - RNA, 19 nt, Artificial Sequence
  Targeting Domain
cuggucccugucucccugg

SEQ ID NO: 2116 - RNA, 20 nt, Artificial Sequence
  Targeting Domain
ccuggucccugucucccugg

SEQ ID NO: 2117 - RNA, 21 nt, Artificial Sequence
  Targeting Domain
gccuggucccugucucccugg

SEQ ID NO: 2118 - RNA, 22 nt, Artificial Sequence
  Targeting Domain
ugccuggucccugucucccugg

SEQ ID NO: 2119 - RNA, 23 nt, Artificial Sequence
  Targeting Domain
cugccuggucccugucucccugg

SEQ ID NO: 2120 - RNA, 24 nt, Artificial Sequence
  Targeting Domain
gcugccuggucccugucucccugg

SEQ ID NO: 2121 - RNA, 18 nt, Artificial Sequence
  Targeting Domain
acucacgaugaaauccug

SEQ ID NO: 2122 - RNA, 19 nt, Artificial Sequence
  Targeting Domain
cacucacgaugaaauccug

SEQ ID NO: 2123 - RNA, 20 nt, Artificial Sequence
  Targeting Domain
acacucacgaugaaauccug

SEQ ID NO: 2124 - RNA, 21 nt, Artificial Sequence
  Targeting Domain
gacacucacgaugaaauccug

SEQ ID NO: 2125 - RNA, 22 nt, Artificial Sequence
  Targeting Domain
ugacacucacgaugaaauccug

SEQ ID NO: 2126 - RNA, 23 nt, Artificial Sequence
  Targeting Domain
cugacacucacgaugaaauccug

SEQ ID NO: 2127 - RNA, 24 nt, Artificial Sequence
  Targeting Domain
gcugacacucacgaugaaauccug

SEQ ID NO: 2128 - RNA, 18 nt, Artificial Sequence
  Targeting Domain
cagaucaacgauuacgug

SEQ ID NO: 2129 - RNA, 19 nt, Artificial Sequence
  Targeting Domain
acagaucaacgauuacgug

SEQ ID NO: 2130 - RNA, 20 nt, Artificial Sequence
  Targeting Domain
aacagaucaacgauuacgug

SEQ ID NO: 2131 - RNA, 21 nt, Artificial Sequence
  Targeting Domain
aaacagaucaacgauuacgug

SEQ ID NO: 2132 - RNA, 22 nt, Artificial Sequence
  Targeting Domain
gaaacagaucaacgauuacgug

SEQ ID NO: 2133 - RNA, 23 nt, Artificial Sequence
  Targeting Domain
agaaacagaucaacgauuacgug

SEQ ID NO: 2134 - RNA, 24 nt, Artificial Sequence
  Targeting Domain
aagaaacagaucaacgauuacgug

SEQ ID NO: 2135 - RNA, 18 nt, Artificial Sequence
  Targeting Domain
ccccccaucucugucuug

SEQ ID NO: 2136 - RNA, 19 nt, Artificial Sequence
  Targeting Domain
cccccccaucucugucuug

SEQ ID NO: 2137 - RNA, 20 nt, Artificial Sequence
  Targeting Domain
gcccccccaucucugucuug

SEQ ID NO: 2138 - RNA, 21 nt, Artificial Sequence
  Targeting Domain
ggcccccccaucucugucuug

SEQ ID NO: 2139 - RNA, 22 nt, Artificial Sequence
  Targeting Domain
uggcccccccaucucugucuug

SEQ ID NO: 2140 - RNA, 23 nt, Artificial Sequence
  Targeting Domain
cuggcccccccaucucugucuug

SEQ ID NO: 2141 - RNA, 24 nt, Artificial Sequence
  Targeting Domain
ccuggcccccccaucucugucuug

SEQ ID NO: 2142 - RNA, 18 nt, Artificial Sequence
  Targeting Domain
aagccuucacugucaacu

SEQ ID NO: 2143 - RNA, 19 nt, Artificial Sequence
  Targeting Domain
gaagccuucacugucaacu

SEQ ID NO: 2144 - RNA, 20 nt, Artificial Sequence
  Targeting Domain
agaagccuucacugucaacu

SEQ ID NO: 2145 - RNA, 21 nt, Artificial Sequence
  Targeting Domain
cagaagccuucacugucaacu

SEQ ID NO: 2146 - RNA, 22 nt, Artificial Sequence
  Targeting Domain
ucagaagccuucacugucaacu

SEQ ID NO: 2147 - RNA, 23 nt, Artificial Sequence
  Targeting Domain
cucagaagccuucacugucaacu

SEQ ID NO: 2148 - RNA, 24 nt, Artificial Sequence
  Targeting Domain
acucagaagccuucacugucaacu

SEQ ID NO: 2149 - RNA, 18 nt, Artificial Sequence
  Targeting Domain
uuaaaaaguuguaccacu

SEQ ID NO: 2150 - RNA, 19 nt, Artificial Sequence
  Targeting Domain
guuaaaaaguuguaccacu

SEQ ID NO: 2151 - RNA, 20 nt, Artificial Sequence
  Targeting Domain
uguuaaaaaguuguaccacu

SEQ ID NO: 2152 - RNA, 21 nt, Artificial Sequence
  Targeting Domain
auguuaaaaaguuguaccacu

SEQ ID NO: 2153 - RNA, 22 nt, Artificial Sequence
  Targeting Domain
gauguuaaaaaguuguaccacu

SEQ ID NO: 2154 - RNA, 23 nt, Artificial Sequence
  Targeting Domain
ggauguuaaaaaguuguaccacu

SEQ ID NO: 2155 - RNA, 24 nt, Artificial Sequence
  Targeting Domain
aggauguuaaaaaguuguaccacu

SEQ ID NO: 2156 - RNA, 18 nt, Artificial Sequence
  Targeting Domain
cuuugcaaugcucucccu

SEQ ID NO: 2157 - RNA, 19 nt, Artificial Sequence
  Targeting Domain
ccuuugcaaugcucucccu

SEQ ID NO: 2158 - RNA, 20 nt, Artificial Sequence
  Targeting Domain
gccuuugcaaugcucucccu

SEQ ID NO: 2159 - RNA, 21 nt, Artificial Sequence
  Targeting Domain
agccuuugcaaugcucucccu

SEQ ID NO: 2160 - RNA, 22 nt, Artificial Sequence
  Targeting Domain
cagccuuugcaaugcucucccu

SEQ ID NO: 2161 - RNA, 23 nt, Artificial Sequence
  Targeting Domain
acagccuuugcaaugcucucccu

SEQ ID NO: 2162 - RNA, 24 nt, Artificial Sequence
  Targeting Domain
uacagccuuugcaaugcucucccu

SEQ ID NO: 2163 - RNA, 18 nt, Artificial Sequence
  Targeting Domain
uucaaccucacggagauu

SEQ ID NO: 2164 - RNA, 19 nt, Artificial Sequence
  Targeting Domain
uuucaaccucacggagauu

SEQ ID NO: 2165 - RNA, 20 nt, Artificial Sequence
  Targeting Domain
auuucaaccucacggagauu

SEQ ID NO: 2166 - RNA, 21 nt, Artificial Sequence
  Targeting Domain
aauuucaaccucacggagauu

SEQ ID NO: 2167 - RNA, 22 nt, Artificial Sequence
  Targeting Domain
gaauuucaaccucacggagauu

SEQ ID NO: 2168 - RNA, 23 nt, Artificial Sequence
  Targeting Domain
ugaauuucaaccucacggagauu

SEQ ID NO: 2169 - RNA, 24 nt, Artificial Sequence
  Targeting Domain
cugaauuucaaccucacggagauu

SEQ ID NO: 2170 - RNA, 18 nt, Artificial Sequence
  Targeting Domain
agccuucacugucaacuu

SEQ ID NO: 2171 - RNA, 19 nt, Artificial Sequence
  Targeting Domain
aagccuucacugucaacuu

SEQ ID NO: 2172 - RNA, 20 nt, Artificial Sequence
  Targeting Domain
gaagccuucacugucaacuu

SEQ ID NO: 2173 - RNA, 21 nt, Artificial Sequence
  Targeting Domain
agaagccuucacugucaacuu

SEQ ID NO: 2174 - RNA, 22 nt, Artificial Sequence
  Targeting Domain
cagaagccuucacugucaacuu

SEQ ID NO: 2175 - RNA, 23 nt, Artificial Sequence
  Targeting Domain
ucagaagccuucacugucaacuu

SEQ ID NO: 2176 - RNA, 24 nt, Artificial Sequence
  Targeting Domain
cucagaagccuucacugucaacuu

SEQ ID NO: 2177 - RNA, 18 nt, Artificial Sequence
  Targeting Domain
aagcuaguggauaaguuu

SEQ ID NO: 2178 - RNA, 19 nt, Artificial Sequence
  Targeting Domain
gaagcuaguggauaaguuu

SEQ ID NO: 2179 - RNA, 20 nt, Artificial Sequence
  Targeting Domain
ugaagcuaguggauaaguuu

SEQ ID NO: 2180 - RNA, 21 nt, Artificial Sequence
  Targeting Domain
cugaagcuaguggauaaguuu

SEQ ID NO: 2181 - RNA, 22 nt, Artificial Sequence
  Targeting Domain
ccugaagcuaguggauaaguuu

SEQ ID NO: 2182 - RNA, 23 nt, Artificial Sequence
  Targeting Domain
gccugaagcuaguggauaaguuu

SEQ ID NO: 2183 - RNA, 24 nt, Artificial Sequence
  Targeting Domain
ggccugaagcuaguggauaaguuu

SEQ ID NO: 2184 - RNA, 18 nt, Artificial Sequence
  Targeting Domain
agcuaguggauaaguuuu

SEQ ID NO: 2185 - RNA, 19 nt, Artificial Sequence
  Targeting Domain
aagcuaguggauaaguuuu

SEQ ID NO: 2186 - RNA, 20 nt, Artificial Sequence
  Targeting Domain
gaagcuaguggauaaguuuu

SEQ ID NO: 2187 - RNA, 21 nt, Artificial Sequence
  Targeting Domain
ugaagcuaguggauaaguuuu

SEQ ID NO: 2188 - RNA, 22 nt, Artificial Sequence
  Targeting Domain
cugaagcuaguggauaaguuuu

SEQ ID NO: 2189 - RNA, 23 nt, Artificial Sequence
  Targeting Domain
ccugaagcuaguggauaaguuuu

SEQ ID NO: 2190 - RNA, 24 nt, Artificial Sequence
  Targeting Domain
gccugaagcuaguggauaaguuuu

SEQ ID NO: 2191 - RNA, 22 nt, Artificial Sequence
  Targeting domain
cugaccaucgacgagaaaggga

SEQ ID NO: 2192 - RNA, 22 nt, Artificial Sequence
  Targeting domain
gacgagaaagggacugaagcug

SEQ ID NO: 2193 - DNA, 74 bp, Artificial Sequence
  ssODN_4 left HDR arm
gggtttgttgaacttgacctcgggggggatagacatgggtatggcctctaaaaacatggccccagcagcctcgg

SEQ ID NO: 2194 - DNA, 22 bp, Artificial Sequence
  ssODN_1, ssODN_2, ssODN_3 mutated target sequence
ctcacaattgataaaaagggca

SEQ ID NO: 2195 - DNA, 22 bp, Artificial Sequence
  ssODN_4, ssODN_5, ssODN_6, ssODN_7 mutated target sequence
tgccctttttatcaattgtgag

SEQ ID NO: 2196 - DNA, 74 bp, Artificial Sequence
  ssODN_1 right HDR arm
ccgaggctgctggggccatgtttttagaggccatacccatgtctatcccccccgaggtcaagttcaacaaaccc

SEQ ID NO: 2197 - DNA, 63 bp, Artificial Sequence
  ssODN_2 right HDR arm
ccgaggctgctggggccatgtttttagaggccatacccatgtctatcccccccgaggtcaagt

SEQ ID NO: 2198 - DNA, 96 bp, Artificial Sequence
  ssODN_3 right HDR arm
ccgaggctgctggggccatgtttttagaggccatacccatgtctatcccccccgaggtcaagttcaacaaaccctttgtcttcttaatgattgaac

SEQ ID NO: 2199 - DNA, 20 bp, Artificial Sequence
  OliSS76 primer
cacgtggtgtcaatccctga

SEQ ID NO: 2200 - DNA, 20 bp, Artificial Sequence
  OliSS82 primer
gctggttgagcaaccttacc

SEQ ID NO: 2201 - DNA, 21 bp, Artificial Sequence
  oliMES2 primer
tgcagttccatgaatggctgc

SEQ ID NO: 2202 - DNA, 25 bp, Artificial Sequence
  oliMES3 primer
cttcttggggactccaagacaggac

SEQ ID NO: 2203 - DNA, 24 bp, Artificial Sequence
  oliMES103 primer
caagttcctggaaaatgaagacag

SEQ ID NO: 2204 - DNA, 21 bp, Artificial Sequence
  oliMES108 primer
acccaggacgctcttcagatc

SEQ ID NO: 2205 - DNA, 23 bp, Artificial Sequence
  oliMES101 primer
tgctatccagaaaacccctcaaa

SEQ ID NO: 2206 - DNA, 20 bp, Artificial Sequence
  oliMES102 primer
ggcgggtggaactgtgttac

SEQ ID NO: 2207 - DNA, 165 bp, Artificial Sequence
  ssODN_1
tcgaggcctgggatcagccttacaacgtgtctctgcttctctcccctccaggccgtgcataaggctgtgctcacaattgataaaaagggcaccgaggctgctggggccatgtttttagaggccatacccatgtctatcccccccgaggtcaagttcaacaaaccc

SEQ ID NO: 2208 - DNA, 88 bp, Artificial Sequence
  ssODN_1/ssODN_1_Z mutation left (5') homology arm sequence relative to break
tcgaggcctgggatcagccttacaacgtgtctctgcttctctcccctccaggccgtgcataaggctgtgctcacaattgataaaaagg

SEQ ID NO: 2209 - DNA, 77 bp, Artificial Sequence
  ssODN_1/ssODN_1_Z mutation right (3') homology arm sequence relative to break
gcaccgaggctgctggggccatgtttttagaggccatacccatgtctatcccccccgaggtcaagttcaacaaaccc

SEQ ID NO: 2210 - DNA, 165 bp, Artificial Sequence
  ssODN_2
gtgagccttgctcgaggcctgggatcagccttacaacgtgtctctgcttctctcccctccaggccgtgcataaggctgtgctcacaattgataaaaagggcaccgaggctgctggggccatgtttttagaggccatacccatgtctatcccccccgaggtcaagt

SEQ ID NO: 2211 - DNA, 99 bp, Artificial Sequence
  ssODN_2/ssODN_2_Z mutation left (5') homology arm sequence relative to break
gtgagccttgctcgaggcctgggatcagccttacaacgtgtctctgcttctctcccctccaggccgtgcataaggctgtgctcacaattgataaaaagg

SEQ ID NO: 2212 - DNA, 66 bp, Artificial Sequence
  ssODN_2/ssODN_2_Z mutation right (3') homology arm sequence relative to break
gcaccgaggctgctggggccatgtttttagaggccatacccatgtctatcccccccgaggtcaagt

SEQ ID NO: 2213 - DNA, 165 bp, Artificial Sequence
  ssODN_3
caacgtgtctctgcttctctcccctccaggccgtgcataaggctgtgctcacaattgataaaaagggcaccgaggctgctggggccatgtttttagaggccatacccatgtctatcccccccgaggtcaagttcaacaaaccctttgtcttcttaatgattgaac

SEQ ID NO: 2214 - DNA, 66 bp, Artificial Sequence
  ssODN_3 left (5') homology arm sequence relative to break
caacgtgtctctgcttctctcccctccaggccgtgcataaggctgtgctcacaattgataaaaagg

SEQ ID NO: 2215 - DNA, 99 bp, Artificial Sequence
  ssODN_3 right (3') homology arm sequence relative to break
gcaccgaggctgctggggccatgtttttagaggccatacccatgtctatcccccccgaggtcaagttcaacaaaccctttgtcttcttaatgattgaac

SEQ ID NO: 2216 - DNA, 165 bp, Artificial Sequence
  ssODN_4
gggtttgttgaacttgacctcgggggggatagacatgggtatggcctctaaaaacatggccccagcagcctcggtgccctttttatcaattgtgagcacagccttatgcacggcctggaggggagagaagcagagacacgttgtaaggctgatcccaggcctcga

SEQ ID NO: 2217 - DNA, 77 bp, Artificial Sequence
  ssODN_4 left (5') homology arm sequence relative to break
gggtttgttgaacttgacctcgggggggatagacatgggtatggcctctaaaaacatggccccagcagcctcggtgc

SEQ ID NO: 2218 - DNA, 88 bp, Artificial Sequence
  ssODN_4 right (3') homology arm sequence relative to break
cctttttatcaattgtgagcacagccttatgcacggcctggaggggagagaagcagagacacgttgtaaggctgatcccaggcctcga

SEQ ID NO: 2219 - DNA, 165 bp, Artificial Sequence
  ssODN_5
acttgacctcgggggggatagacatgggtatggcctctaaaaacatggccccagcagcctcggtgccctttttatcaattgtgagcacagccttatgcacggcctggaggggagagaagcagagacacgttgtaaggctgatcccaggcctcgagcaaggctcac

SEQ ID NO: 2220 - DNA, 132 bp, Artificial Sequence
  ssODN_5 left (5') homology arm sequence relative to break
acttgacctcgggggggatagacatgggtatggcctctaaaaacatggccccagcagcttcagtccacttgacctcgggggggatagacatgggtatggcctctaaaaacatggccccagcagcctcggtgc

SEQ ID NO: 2221 - DNA, 99 bp, Artificial Sequence
  ssODN_5 right (3') homology arm sequence relative to break
cctttttatcaattgtgagcacagccttatgcacggcctggaggggagagaagcagagacacgttgtaaggctgatcccaggcctcgagcaaggctcac

SEQ ID NO: 2222 - DNA, 165 bp, Artificial Sequence
  ssODN_6
gttcaatcattaagaagacaaagggtttgttgaacttgacctcgggggggatagacatgggtatggcctctaaaaacatggccccagcagcctcggtgccctttttatcaattgtgagcacagccttatgcacggcctggaggggagagaagcagagacacgttg

SEQ ID NO: 2223 - DNA, 99 bp, Artificial Sequence
  ssODN_6 left (5') homology arm sequence relative to break
gttcaatcattaagaagacaaagggtttgttgaacttgacctcgggggggatagacatgggtatggcctctaaaaacatggccccagcagcctcggtgc

SEQ ID NO: 2224 - DNA, 66 bp, Artificial Sequence
  ssODN_5 right (3') homology arm sequence relative to break
cctttttatcaattgtgagcacagccttatgcacggcctggaggggagagaagcagagacacgttg

SEQ ID NO: 2225 - DNA, 165 bp, Artificial Sequence
  ssODN_7
ggagacttggtattttgttcaatcattaagaagacaaagggtttgttgaacttgacctcgggggggatagacatgggtatggcctctaaaaacatggccccagcagcctcggtgccctttttatcaattgtgagcacagccttatgcacggcctggaggggagag

SEQ ID NO: 2226 - DNA, 115 bp, Artificial Sequence
  ssODN_7 left (5') homology arm sequence relative to break
ggagacttggtattttgttcaatcattaagaagacaaagggtttgttgaacttgacctcgggggggatagacatgggtatggcctctaaaaacatggccccagcagcctcggtgc

SEQ ID NO: 2227 - DNA, 50 bp, Artificial Sequence
  ssODN_7 right (3') homology arm sequence relative to break
cctttttatcaattgtgagcacagccttatgcacggcctggaggggagag

SEQ ID NO: 2228 - DNA, 165 bp, Artificial Sequence
  ssODN_1_Z mutation
tcgaggcctgggatcagccttacaacgtgtctctgcttctctcccctccaggccgtgcataaggctgtgctcacaattgatgagaagggcaccgaggctgctggggccatgtttttagaggccatacccatgtctatcccccccgaggtcaagttcaacaaaccc

SEQ ID NO: 2229 - DNA, 165 bp, Artificial Sequence
  ssODN_2_Z mutation
gtgagccttgctcgaggcctgggatcagccttacaacgtgtctctgcttctctcccctccaggccgtgcataaggctgtgctcacaattgatgagaagggcaccgaggctgctggggccatgtttttagaggccatacccatgtctatcccccccgaggtcaagt

SEQ ID NO: 2230 - DNA, 22 bp, Artificial Sequence
  ssODN_1_Z and ssODN_2_Z mutated target sequence
ctcacaattgatgagaagggca

SEQ ID NO: 2231 - DNA, 16534 bp, Homo sapiens
  exon (1908)..(2180): Exon Ia
  exon (3590)..(3781): Exon Ib
  exon (3937)..(4040): Exon Ic
  exon (9359)..(10008): Exon II
  exon (11459)..(11729): Exon III
  misc_feature (11675)..(11675): Site of c.863A>T mutation giving rise to E264V ("S mutation")
  exon (12989)..(13136): Exon IV
  exon (13960)..(15853): Exon V
  misc_feature (13990)..(13990): Site of c.1096G>A mutation giving rise to E342K (Z mutation)
  misc_feature (13990)..(13990): Site of c.1096G>A mutation giving rise to E342K ("Z mutation")
  3'UTR (14152)..(14406)
gtgactggaggaggtgaaaaaatggtgcaaacttcattcattcattaaatgagttataagaagacagacacaagtgtccattatgctaacagagctctgtgttaaacaccccaccagcatcgcctcatctaagcctcagaagagctatgtgggaaagaaacttttatccctattttatagatgaggaaaccaaggctcagagaactgagggcctcccccggatccaagtccacctagctgcagtcaccccacatcctctgcatgtcacaggtgctcagaaagatgctgaaggcacctggcccttcaccttcggaaagccaaaatgagcacggcccctaaagaggggattgacagccttttctggaaaaaatggaagtttgaatctgaggaggtgtccctcaacaacaggtgctgctccccaaatctggggccaaacgcagcagttgttcccccacttagacccctgagacccatctatatggtttttcagagccaggacacatccccaaaggtcatggcctttggtggttagcattgacttggggcccatcacatgccagaggctgcccgaagtgcttaaatgttattatctcattcgatcttcacagtcctgatggaagtgactcttcttagagtcttcctatctcacagatgaggaaaccgaggcacagagaggttaagtggcttgtctaagagctcacaaaaagagcgatggagctaaggcttggccccagatattagatcccgaacccacgccttaaccagtgacctgcactgactctcaaagaaggaagctggtgcctgggaaggagggtgcatagtgagggtgtgcatggggtgtgtgtgtttgtggggtggccagcactctccgggggcactttgccaatgagttcagctcccatgaagtccactgttgttctcctgaccagccactcagtcttgatttacttggcccagggccactggcacacctcacccccttacccgattccttgctgcagaccccaaatctcgactctcacatccctatccagcccataccacgaggctcccatctccaggcagggccctgtggtggggcagggcctcccccagatgccccttactcatgaccagctcacaggatcttcccatgatgcatttcctctggggggatcagcccagatgctgcaatagacaattgtggaagtaaccaggtggacaagactttccccctcatgtcctggggttcctgggggcacagtatccttgtgaatggccactgagtactcccacccctcccaccacaacccccgggattttgtcctggtgcgtttttccagattatcctagcccttcctcccaggatggatgtccagagcagggcgggggctgagcctagagccctgccaaaagagcaggaccccaaattctgagccccttacttgcctcacctgctcccacccatgctttcttcattcctcctccaaaagccccagctccccactgcaatcccttctgcacccagccaggtcctatgacacacacctccccagtgcacacagacctgcccaactgtggggctgcccactgggcatttcataggtggctcagtcctcttccctctgcagctggccccagaaacctgccagttattggtgccaggtctgtgccaggagggcgaggcctgtcatttctagtaatcctctgggcagtgtgactgtacctcttgcggcaactcaaagggagagggtgacttgtcccgggtcacagagctgaaagggcaggtacaacaggtgacatgccgggctgtctgagtttatgagggcccagtcttgtgtctgccgggcaatgagcaaggctccttcctgtccaagctccccgcccctccccagcctactgcctccacccgaagtctacttcctgggtgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacaggtgggagggacagcagggcttagagtgggggtcattgtgcagatgggaaaacaaaggcccagagaggggaagaaatgcccaggagctaccgagggcaggcgacctcaaccacagcccagtgctggagctgtgagtggatgtagagcagcggaatatccattcagccagctcaggggaaggacaggggccctgaagccaggggatggagctgcagggaagggagctcagagagaaggggaggggagtctgagctcagtttcccgctgcctgaaaggagggtggtacctactcccttcacagggtaactgaatgagagactgcctggaggaaagctcttcaagtgtggcccaccccaccccagtgacaccagcccctgacacgggggagggagggcagcatcaggaggggctttctgggcacacccagtacccgtctctgagctttccttgaactgttgcattttaatcctcacagcagctcaacaaggtacataccgtcaccatccccattttacagatagggaaattgaggctcggagcggttaaacaactcacctgaggcctcacagccagtaagtgggttccctggtctgaatgtgtgtgctggaggatcctgtgggtcactcgcctggtagagccccaaggtggaggcataaatgggactggtgaatgacagaaggggcaaaaatgcactcatccattcactctgcaagtatctacggcacgtacgccagctcccaagcaggtttgcgggttgcacagcgggcgatgcaatctgatttaggcttttaaagggattgcaatcaagtggggccccactagcctcaaccctgtacctcccctcccctccacccccagcagtctccaaaggcctccaacaaccccagagtgggggccatgtatccaaagaaactccaagctgtatacggatcacactggttttccaggagcaaaaacagaaacaggcctgaggctggtcaaaattgaacctcctcctgctctgagcagcctggggggcagactaagcagagggctgtgcagacccacataaagagcctactgtgtgccaggcacttcacccgaggcacttcacaagcatgcttgggaatgaaacttccaactctttgggatgcaggtgaaacagttcctggttcagagaggtgaagcggcctgcctgaggcagcacagctcttctttacagatgtgcttccccacctctaccctgtctcacggccccccatgccagcctgacggttgtgtctgcctcagtcatgctccatttttccatcgggaccatcaagagggtgtttgtgtctaaggctgactgggtaactttggatgagcggtctctccgctctgagcctgtttcctcatctgtcaaatgggctctaacccactctgatctcccagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgtaagtatgcctttcactgcgagaggttctggagaggcttctgagctccccatggcccaggcaggcagcaggtctggggcaggaggggggttgtggagtgggtatccgcctgctgaggtgcagggcagatggagaggctgcagctgagctcctattttcataataacagcagccatgagggttgtgtcctgtttcccagtcctgcccggtcccccctcggtacctcctggtggatacactggttcctgtaagcagaagtggatgagggtgtctaggtctgcagtcctggcaccccaggatgggggacaccagccaagatacagcaacagcaacaaagcgcagccatttctttctgtttgcacagctcctctgtctgtcgggggctcctgtctgttgtctcctataagcctcaccacctctcctactgcttgggcatgcatctttctccccttctatagatgaggaggttaaggtccagagaggggtggggaggaacgccggctcacattctccatcccctccagatatgaccaggaacagacctgtgccaggcctcagccttacatcaaaatgggcctccccatgcaccgtggacctctgggccctcctgtcccagtggaggacaggaagctgtgaggggcactgtcacccagggctcaagctggcattcctgaataatcgctctgcaccaggccacggctaagctcagtgcgtgattaagcctcataaccctccaaggcagttactagtgtgattcccattttacagatgaggaagatggggacagagaggtgaataactggccccaaatcacacaccatccataattcgggctcaggcacctggctccagtccccaaactcttgaacctggccctagtgtcactgtttctcttgggtctcaggcgctggatggggaacaggaaacctgggctggacttgaggcctctctgatgctcggtgacttcagacagttgctcaacctctctgttctcttgggcaaaacatgataacctttgacttctgtcccctcccctcaccccacccgaccttgatctctgaagtgttggaaggatttaatttttcctgcactgagttttggagacaggtcaaaaagatgaccaaggccaaggtggccagtttcctatagaacgcctctaaaagacctgcagcaatagcagcaagaactggtattctcgagaacttgctgcgcagcaggcacttcttggcattttatgtgtatttaatttcacaatagctctatgacaaagtccacctttctcatctccaggaaactgaggttcagagaggttaagtaacttgtccaaggtcacacagctaatagcaagttgacgtggagcaatctggcctcagagcctttaattttagccacagactgatgctcccctcttcatttagccaggctgcctctgaagttttctgattcaagacttctggcttcagctttgtacacagagatgattcaatgtcaggttttggagtgaaatctgtttaatcccagacaaaacatttaggattacatctcagttttgtaagcaagtagctctgtgatttttagtgagttatttaatgctctttggggctcaatttttctatctataaaatagggctaataatttgcaccttatagggtaagctttgaggacagattagatgatacggtgcctgtaaaacaccaggtgttagtaagtgtggcaatgatggtgacgctgaggctgatgtttgcttagcatagggttaggcagctggcaggcagtaaacagttggataatttaatggaaaatttgccaaactcagatgctgttcactgctgagcaggagccccttcctgctgaaatggtcctggggagtgcagcaggctctccgggaagaaatctaccatctctcgggcaggagctcaacctgtgtgcaggtacagggagggcttcctcacctggtgcccactcatgcattacgtcagttattcctcatccctgtccaaaggattcttttctccattgtacagctatgaagctagtgctcaaagaagtgaagtcatttaccccaggccccctgccagtaagtgacagggcctggtcacacttgggtttatttattgcccagttcaacaggttgtttgaccataggcgagattctcttccctgcaccctgccgggttgctcttggtcccttattttatgctcccgggtagaaatggtgtgagattaggcagggagtggctcgcttccctgtccctggccccgcaaagagtgctcccacctgccccgatcccagaaatgtcaccatgaagccttcattcttttggtttaaagcttggcctcagtgtccgtacaccatggggtacttggccagatggcgactttctcctctccagtcgccctcccaggcactagcttttaggagtgcagggtgctgcctctgatagaagggccaggagagagcaggttttggagtcctgatgttataaggaacagcttgggaggcataatgaacccaacatgatgcttgagaccaatgtcacagcccaattctgacattcatcatctgagatctgaggacacagctgtctcagttcatgatctgagtgctgggaaagccaagacttgttccagctttgtcactgacttgctgtatagcctcaacaaggccctgaccctctctgggcttcaaactcttcactgtgaaaggaggaaaccagagtaggtgatgtgacaccaggaaagatggatgggtgtgggggaatgtgctcctcccagctgtcaccccctcgccaccctccctgcaccagcctctccacctcctttgagcccagaattcccctgtctaggagggcacctgtctcatgcctagccatgggaattctccatctgttttgctacattgaacccagatgccattctaaccaagaatcctggctgggtgcaggggctctcgcctgtaaccccagcactttgggaggccaaggcaggcggatcaagaggtcaggagttcaagacctgcctggccaacacggtgaaacctcagctctactaaaaatacaaaaattagccaggcgtggtggcacacgcctgtaatcccagctatttgggaagctgagacagaagaatttcttgaacccgggaggtggaggtttcagtgagccgagatcacgccactgcactccaccctggcagataaagcgagactctgtctcaaaaaaaacccaaaaacctatgttagtgtacagagggccccagtgaagtcttctcccagccccactttgcacaactggggagagtgaggccccaggaccagaggattcttgctaaaggccaagtggatagtgatggccctgccagggctagaagccacaacctctggccctgaggccactcagcatatttagtgtccccaccctgcagaggcccaactccctcctgaccactgagccctgtaatgatgggggaatttccataagccatgaaggactgcacaaagttcagttgggaagtgaaagagaaattaaagggagatggaaatatacagcactaattttagcaccgtctttagttctaacaacactagctagctgaagaaaaatacaaacatgtattatgtaatgtgtggtctgttccatttggattacttagaggcacgagggccaggagaaaggtggtggagagaaaccagctttgcacttcatttgttgctttattggaaggaaacttttaaaagtccaagggggttgaagaatctcaatatttgttatttccagctttttttctccagtttttcatttcccaaattcaaggacacctttttctttgtattttgttaagatgatggttttggttttgtgactagtagttaacaatgtggctgccgggcatattctcctcagctaggacctcagttttcccatctgtgaagacggcaggttctacctagggggctgcaggctggtggtccgaagcctgggcatatctggagtagaaggatcactgtggggcagggcaggttctgtgttgctgtggatgacgttgactttgaccattgctcggcagagcctgctctcgctggttcagccacaggccccaccactccctattgtctcagccccgggtatgaaacatgtattcctcactggcctatcacctgaagcctttgaatttgcaacacctgccaacccctccctcaaaagagttgccctctcagatccttttgatgtaaggtttggtgttgagacttatttcactaaattctcatacataaacatcactttatgtatgaggcaaaatgaggaccagggagatgaatgacttgtcctggctcatacacctggaaagtgacagagtcagattagatcccaggtctatctgaagttaaaagaggtgtcttttcacttcccacctcctccatctactttaaagcagcacaaacccctgctttcaaggagagatgagcgtctctaaagcccctgacagcaagagcccagaactgggacaccattagtgacccagacggcaggtaagctgactgcaggagcatcagcctattcttgtgtctgggaccacagagcattgtggggacagccccgtctcttgggaaaaaaaccctaagggctgaggatccttgtgagtgttgggtgggaacagctcccaggaggtttaatcacagcccctccatgctctctagctgttgccattgtgcaagatgcatttcccttctgtgcagcagtttccctggccactaaatagtgggattagatagaagccctccaagggcttccagcttgacatgattcttgattctgatctggcccgattcctggataatcgtgggcaggcccattcctcttcttgtgcctcattttcttcttttgtaaaacaatggctgtaccatttgcatcttagggtcattgcagatgtaagtgttgctgtccagagcctgggtgcaggacctagatgtaggattctggttctgctacttcctcagtgacattgaatagctgacctaatctctctggctttggtttcttcatctgtaaaagaaggatattagcattagcacctcacgggattgttacaagaaagcaatgaattaacacatgtgagcacggagaacagtgcttggcatatggtaagcactacgtacattttgctattcttctgattctttcagtgttactgatgtcggcaagtacttggcacaggctggtttaataatccctaggcacttccacgtggtgtcaatccctgatcactgggagtcatcatgtgccttgactcggggcctggcccccccatctctgtcttgcaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggtaaggttgctcaaccagcctgagctgttcccatagaaacaagcaaaaatattctcaaaccatcagttcttgaactctccttggcaatgcattatgggccatagcaatgcttttcagcgtggattcttcagttttctacacacaaacactaaaatgttttccatcattgagtaatttgaggaaataatagattaaactgtcaaaactactgacagctctgcagaacttttcagagcctttaatgtccttgtgtatactgtatatgtagaatatataatgcttagaactatagaacaaattgtaatacactgcataaagggatagtttcatggaacatactttacacgactctagtgtcccagaatcagtatcagttttgcaatctgaaagacctgggttcaaatcctgcctctaacacaattagcttttgacaaaaacaatgcattctacctctttgaggtgctaatttctcatcttagcatggacaaaataccattcttgctgtcaggtttttttaggattaaacaaatgacaaagactgtggggatggtgtgtggcatacagcaggtgatggactcttctgtatctcaggctgccttcctgcccctgaggggttaaaatgccagggtcctgggggccccagggcattctaagccagctcccactgtcccaggaaaacagcataggggaggggaggtgggaggcaaggccaggggctgcttcctccactctgaggctcccttgctcttgaggcaaaggagggcagtggagagcagccaggctgcagtcagcacagctaaagtcctggctctgctgtggccttagtgggggcccaggtccctctccagccccagtctcctccttctgtccaatgagaaagctgggatcaggggtccctgaggcccctgtccactctgcatgcctcgatggtgaagctctgttggtatggcagaggggaggctgctcaggcatctgcatttcccctgccaatctagaggatgaggaaagctctcaggaatagtaagcagaatgtttgccctggatgaataactgagctgccaattaacaaggggcagggagccttagacagaaggtaccaaatatgcctgatgctccaacattttatttgtaatatccaagacaccctcaaataaacatatgattccaataaaaatgcacagccacgatggcatctcttagcctgacatcgccacgatgtagaaattctgcatcttcctctagttttgaattatccccacacaatctttttcggcagcttggatggtcagtttcagcaccttttacagatgatgaagctgagcctcgagggatgtgtgtcgtcaagggggctcagggcttctcagggaggggactcatggtttctttattctgctacactcttccaaaccttcactcacccctggtgatgcccaccttcccctctctccaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtgattccccaacctgagggtgaccaagaagctgcccacacctcttagccatgttgggactgaggcccatcaggactggccagagggctgaggagggtgaaccccacatccctgggtcactgctactctgtataaacttggcttccagaatgaggccaccactgagttcaggcagcgccatccatgctccatgaggaggacagtacccaggggtgaggaggtaaaggtctcgtccctggggacttcccactccagtgtggacactgtcccttcccaatatccagtgcccagggcagggacagcagcaccaccacacgttctggcagaaccaaaaaggaacagatgggcttcctggcaaaggcagcagtggagtgtggagttcaagggtagaatgtccctggggggacgggggaagagcctgtgtggcaaggcccagaaaagcaaggttcggaattggaacagccaggccatgttcgcagaaggcttgcgtttctctgtcactttatcggtgctgttagattgggtgtcctgtagtaagtgatacttaaacatgagccacacattagtgtatgtgtgtgcattcgtgattatgcccatgccctgctgatctagttcgttttgtacactgtaaaaccaagatgaaaatacaaaaggtgtcgggttcataataggaatcgaggctggaatttctctgttccatgccagcacctcctgaggtctctgctccaggggttgagaaagaacaaagaggctgagagggtaacggatcagagagcccagagccaagctgcccgctcacaccagaccctgctcagggtggcattgtctccccatggaaaaccagagaggagcactcagcctggtgtggtcactcttctcttatccactaaacggttgtcactgggcactgccaccagccccgtgtttctctgggtgtagggccctggggatgttacaggctgggggccaggtgacccaacactacagggcaagatgagacaggcttccaggacacctagaatatcagaggaggtggcatttcaagcttttgtgattcattcgatgttaacattctttgactcaatgtagaagagctaaaagtagaacaaaccaaagccgagttcccatcttagtgtgggtggaggacacaggagtaagtggcagaaataatcagaaaagaaaacacttgcactgtggtgggtcccagaagaacaagaggaatgctgtgccatgccttgaatttcttttctgcacgacaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggtgagatcaccctgacgaccttgttgcaccctggtatctgtagggaagaatgtgtgggggctgcagctctgtcctgaggctgaggaaggggccgagggaaacaaatgaagacccaggctgagctcctgaagatgcccgtgattcactgacacgggacgtggtcaaacagcaaagccaggcaggggactgctgtgcagctggcactttcggggcctcccttgaggttgtgtcactgaccctgaatttcaactttgcccaagaccttctagacattgggccttgatttatccatactgacacagaaaggtttgggctaagttgtttcaaaggaatttctgactccttcgatctgtgagatttggtgtctgaattaatgaatgatttcagctaaagatgacacttattttggaaaactaaaggcgaccaatgaacaactgcagttccatgaatggctgcattatcttggggtctgggcactgtgaaggtcactgccagggtccgtgtcctcaaggagcttcaagccgtgtactagaaaggagagagccctggaggcagacgtggagtgacgatgctcttccctgttctgagttgtgggtgcacctgagcagggggagaggcgcttgtcaggaagatggacagaggggagccagccccatcagccaaagccttgaggaggagcaaggcctatgtgacagggagggagaggatgtgcagggccagggccgtccagggggagtgagcgcttcctgggaggtgtccacgtgagccttgctcgaggcctgggatcagccttacaacgtgtctctgcttctctcccctccaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttatgagctttctgtgaatcagacatccctatgaagtacctcccctggctgtttctcatttactcactgtagcagcactgcgatgtgtgagtatatctgctgtgctcttaaactccaaatctgaggaaactgaggctcagagaggctactggtctcccacaatgtcacacagctcataagtggcaaagctggcttgatgggctacttgttcctctgaaccataccacctcaccacactctccccttcgagggtcacgctaaacttctgcagaggtaattcctccttaaaccagaagggttgctggtggcccacagctcacgcctagcacacttcatgagaaaaacaccctgtgcccagtgtggagcaggcattgagctgaaggtggtgagcagaagctcatccaccagatgttgacacagcccgcagccttgggcgacccacaggactcctcttatttaactggcatttggtaggagaacaggggcagagtcaaagacaagttggctttctggagagcccagggcagggaaggaggtggcagcgctgagggcggtcaccttagacaccatcgttttactttgaagaattgtctgtcacacacgagttgacagtcaggatgggagagaccccattcaaactagcataacctcccagagggaattcctgggctcccctggga

What is claimed is:

1. A method of altering a cell comprising contacting the cell with
    a first guide RNA (gRNA) comprising a first targeting domain configured to provide a first cleavage event in a first target domain located in a region of Exon II of the SERPINA 1 gene, wherein the first target domain is complementary to a sequence that is the same as, or differs by no more than 3 nucleotides from, a sequence set forth in SEQ ID NO:1390 or
    a first nucleotide sequence encoding the first gRNA; and
    an RNA-guided nuclease or
    a second nucleotide sequence encoding an RNA-guided nuclease.

2. The method of claim 1, wherein the RNA-guided nuclease is Cas9.

3. The method of claim 2, wherein the first targeting domain consists of 22 to 26 nucleotides and comprises the sequence set forth in SEQ ID NO:1390.

4. The method of claim 3, further comprising contacting the cell with a third nucleotide sequence including a complementary DNA (cDNA) encoding alpha-1 antitrypsin (A1AT) protein or comprising a wild-type SERPINA1 gene.

5. The method of claim 4, further comprising contacting the cell with
    a second gRNA comprising a second targeting domain configured to provide a second cleavage event in a second target domain located in a region of Exon II of the SERPINA 1 gene or
    a fourth nucleotide sequence encoding the second gRNA.

6. The method of claim 5, wherein the first and second nucleotide sequences are present on a first nucleic acid molecule and the third nucleotide sequence is present on a second nucleic acid molecule.

7. The method of claim 6, wherein the first and second nucleic acid molecules are AAV vectors.

8. A method of altering a cell comprising contacting the cell with
    a first guide RNA (gRNA) comprising a first targeting domain configured to provide a first cleavage event in a first target domain located in a region of Exon II of the SERPINA 1 gene, wherein the first target domain is complementary to a sequence that is the same as, or differs by no more than 3 nucleotides from, a sequence set forth in SEQ ID NO:1811 or
    a first nucleotide sequence encoding the first gRNA; and
    an RNA-guided nuclease or
    a second nucleotide sequence encoding an RNA-guided nuclease.

9. The method of claim 8, wherein the RNA-guided nuclease is Cas9.

10. The method of claim 9, wherein the first targeting domain consists of 22 to 26 nucleotides and comprises the sequence set forth in SEQ ID NO:1811.

11. The method of claim 10, further comprising contacting the cell with
    a third nucleotide sequence including a cDNA encoding alpha-1 antitrypsin (A1AT) protein or comprising a wild-type SERPINA1 gene.

12. The method of claim 11, further comprising contacting the cell with
    a second gRNA comprising a second targeting domain configured to provide a second cleavage event in a second target domain located in a region of Exon II of the SERPINA 1 gene or
    a fourth nucleotide sequence encoding the second gRNA.

13. The method of claim 12, wherein the first and second nucleotide sequences are present on a first nucleic acid molecule and the third nucleotide sequence is present on a second nucleic acid molecule.

14. The method of claim 13, wherein the first and second nucleic acid molecules are AAV vectors.

* * * * *